United States Patent
Foster et al.

(10) Patent No.: US 7,410,647 B2
(45) Date of Patent: Aug. 12, 2008

(54) ANTIGENIC POLYPEPTIDES

(75) Inventors: Simon Foster, Hathersage (GB); James Mond, Silver Spring, MD (US); Simon Clarke, Sheffield (GB); Philip McDowell, Middlesex (GB); Kristy Brummel, Sheffield (GB)

(73) Assignees: University of Sheffield, Sheffield (GB); Biosynexus Incorporated, Gaithersburg, MD (US)

( * ) Notice: Subject to any disclaimer, the term of this patent is extended or adjusted under 35 U.S.C. 154(b) by 369 days.

(21) Appl. No.: 10/485,517

(22) PCT Filed: Aug. 2, 2002

(86) PCT No.: PCT/GB02/03606

§ 371 (c)(1),
(2), (4) Date: Sep. 16, 2004

(87) PCT Pub. No.: WO03/011899

PCT Pub. Date: Feb. 13, 2003

(65) Prior Publication Data

US 2005/0256299 A1 Nov. 17, 2005

(30) Foreign Application Priority Data

Aug. 2, 2001 (GB) ................... 0118825.9
Jan. 9, 2002 (GB) ................... 0200349.9

(51) Int. Cl.
*A61K 39/085* (2006.01)
*A61K 39/00* (2006.01)
*C12P 21/04* (2006.01)
*C07H 21/04* (2006.01)
*C07K 14/00* (2006.01)

(52) U.S. Cl. .............. 424/243.1; 424/234.1; 424/184.1; 530/350; 530/300; 536/23.7; 435/320.1; 435/252.1; 435/199; 435/69.7

(58) Field of Classification Search .............. 435/320.1, 435/252.1, 199, 69.7; 424/244.1, 234, 243.1, 424/234.1, 184.1; 530/300, 350; 536/23.7
See application file for complete search history.

(56) References Cited

U.S. PATENT DOCUMENTS 5,543,323 A 8/1996 Ridley et al.
6,086,896 A 7/2000 Sparling et al.

FOREIGN PATENT DOCUMENTS

WO WO 99/50418 10/1999
WO WO 02/094868 11/2002
WO WO 02/102829 12/2002

OTHER PUBLICATIONS

Rudinger et al, in "Peptide Hormones", edited by Parsons, J.A., University Park Press, Jun. 1976.*
Burgess et al., The Journal of Cell Biology, 111:2129 2138, 1990.*
Lazar et al., Molecular and Cellular Biology, 8(3): 1247 1252, 1988.*
Jobling et al. (Mol. Microbiol. 1991, 5(7): 1755 67.*
Coleman et al. (Research in Immunology, 1994; 145(1): 33-36.*
Abaza et al. (Journal of Protein Chemistry, vol. 11, No. 5, 1992, pp. 433-444.*
Roitt et al, 1998, Immunology, 4th ed, Mosby, London p. 7.7-7.8.*
Holmes (Exp. Opin.Invest. Drugs, 2001, 10(3):511-519.*
Herbert et al. (The Dictionary of Immunology, Academic Press, 4th edition, 1995, p. 58).*
Greenspan et al., Nature Biotechnology 7:936-937 (1999).*
Barash et al., *Staphylococcus aureus polynucleotides and sequences* (Mar. 1999); Accession No. XP002250642.
Kuroda et al., *Whole genome sequencing of meticillin-resistant Staphylococcus aureus* (Jun. 2001); Accession No. XP002250643.
Sahin et al., *Serological identification of human tumor antigens*, Current Opinion in Immunology, vol. 9, No. 5, pp. 709-716 (Oct. 1997).
Wood et al., *Identification of antigenic sites on staphylococcal enterotoxin B and toxoid*, FEMS Immunology and Medicinal Microbiology, vol. 17, pp. 1-10 (1997).
Masignani et al., *Staphylococcus aureus proteins and nucleic acids* (Feb. 2003); Accession No. XP002250644.
Masignani, *Staphylococcus aureus proteins and nucleic acids* (Feb. 2003); Accession No. XP002250645.
Masignani, *Staphylococcus aureus proteins and nucleic acids* (Feb. 2003); Accession No. XP002250646.
Masignani, *Staphylococcus aureus proteins and nucleic acids* (Feb. 2003); Accession No. XP002250647.
Kuroda et al., "Whole genome sequencing of meticillin-resistant *Staphylococcus aureus*," Lancet. Apr. 21, 2001;357(9264):1225-40.
Rahman, A. et al., "Gamma-Hemolysin Genes in the Same Family with *Luk-F* and *luk S* Genes in Methillicin Resistant *Staphylococcus aureus*," Biosci. Biotech. Biohem., 57(7):1234-36 (1993).
Foster, Simon, "Molecular Characterization and Functional Analysis of the Major Autolysin of *Staphylococcus aureus* 8325/4," *J. of Bacteriology*, 177(19):5723-5725 (1995).
US 6,159,469, 12/2000, Choi et al. (withdrawn)

* cited by examiner

*Primary Examiner*—Shanon A. Foley
*Assistant Examiner*—Padma v Baskar
(74) *Attorney, Agent, or Firm*—Casimir Jones S.C.

(57) ABSTRACT

A method for the identification of antigenic polypeptides, typically opsonic antigens, expressed by pathogenic microbes; vaccines comprising said antigens; and therapeutic antibodies directed to said antigenic polypeptides.

4 Claims, No Drawings

ANTIGENIC POLYPEPTIDES

The present application claims the benefit of priority to PCT International Application No. PCT/GB02/03606, filed Aug. 2, 2002, which claims the benefit of priority to Great Britain Patent Application No. 0200349.9, filed Jan. 9, 2002, and Great Britain Patent Application No. 0118825.9, filed Aug. 2, 2001.

The invention relates to a method for the identification of antigenic polypeptides, typically opsonic antigens, expressed by pathogenic microbes; vaccines comprising said antigens; and therapeutic antibodies directed to said antigenic polypeptides.

Microbial organisms cause a number of fatal or debilitating diseases which affect many millions of people around the world. Currently methods to control microbial organisms include the use of antimicrobial agents (antibiotics) and disinfectants. These have proved to be problematic since exposure to these agents places a significant selection pressure resulting in the creation of resistant microbes which can avoid the effects of the antimicrobial agent(s). For example, recently it has been discovered that microbial organisms have become resistant to triclosan, an agent added to many disinfectants used in households and industrial environments.

An arguably greater problem is the evolution of antibiotic resistant strains of a number of significant pathogenic microbes.

For example, and not by way of limitation, it is estimated that there are up to 50 million people world-wide infected with drug resistant tuberculosis (TB) (Figures from the World Health Organisation, 1998). In the past the use of antibiotics to treat TB relied on the administration of single drugs (eg ethionamide) which promoted a relatively high frequency of resistance. For this reason, combinations of drugs are now used to treat tuberculosis. However the fatality rate in cases caused by strains that are resistant to at least one drug used to treat tuberculosis still approaches 50% even when treatment is given. *Mycobacterium tuberculosis*, the causative agent of TB, is a slow growing bacteria and takes a long time to kill. Therefore, for a drug combination to be effective a person with TB must take the drug combination daily for at least six months. Accordingly, patients frequently have to take two or more pills daily and this requires a regimented dosage over a relatively long period of treatment. Many patients take the medications only intermittently and therefore do not finish the full course of therapy to completely eradicate the *M. tuberculosis* infection. Moreover, TB is strongly associated with HIV infection and therefore the establishment of TB is strongly correlated with immunosuppression.

Vaccination against TB has been available for many years. The bacillus calmette and guerin (BCG) vaccination has been widely used throughout the world for a long time because it is a safe and inexpensive means to vaccinate large numbers of people who potentially could contract TB. BCG is derived from live, attenuated strains of *Mycobacterium bovis*. However the impact of vaccination on the infectious forms of TB is minimal and BCG has therefore contributed little to the overall control of the disease.

A further example of a pathogenic organism which has developed resistance to antibiotics is *Staphylococcus aureus*. *S. aureus* is a bacterium whose normal habitat is the epithelial lining of the nose in about 20-40% of normal healthy people and is also commonly found on people's skin usually without causing harm. However, in certain circumstances, particularly when skin is damaged, this germ can cause infection. This is a particular problem in hospitals where patients may have surgical procedures and/or be taking immunosuppressive drugs. These patients are much more vulnerable to infection with *S. aureus* because of the treatment they have received. Resistant strains of *S. aureus* have arisen in recent years. Methicillin resistant strains are prevalent and many of these resistant strains are also resistant to several other antibiotics. Currently there is no effective vaccination procedure for *S. aureus*. In the U.S., *S. aureus* infections are the cause of 13% of the two million hospitalised infections each year. This represents 260,000 people with an infection of *S. aureus*, of which 60-80,000 die.

*S. aureus* is therefore a major human pathogen capable of causing a wide range of life threatening diseases including septicaemia, endocarditis, arthritis and toxic shock. This ability is determined by the versatility of the organism and its arsenal of components involved in virulence. Pathogenicity is multifactorial and no one component has shown to be responsible for a particular infection, see Projan, S. J. & Novick, R. P. (1997) in The Staphylococci in Human Disease (Crossley, K. B. & Archer, G. L., eds.) pp. 55-81.

At the onset of infection, and as it progresses, the needs and environment of the organism changes and this is mirrored by a corresponding alteration in the virulence determinants which *S. aureus* produces. At the beginning of infection it is important for the pathogen to adhere to host tissues and so a large repertoire of cell surface associated attachment proteins are made. These include collagen-, fibrinogen- and fibronectin-binding proteins. The pathogen also has the ability to evade host defences by the production of factors that reduce phagocytosis or interfere with the ability of the cells to be recognised by circulating antibodies.

Often a focus of infection develops as an abscess and the number of organisms increases. *S. aureus* has the ability to monitor its own cell density by the production of a quorum sensing peptide. Accumulation of the peptide, associated with physiological changes brought about by the beginning of starvation of the cells, elicits a switch in virulence determinant production from adhesions to components involved in invasion and tissue penetration. These include a wide range of hemolysins, proteases and other degradative enzymes.

During the process of any infection the virulence determinants made by *S. aureus* are produced in response to environmental and physiological stimuli. These stimuli will be dependent on the niche within the body and will change as the infection progresses. Little is known of the conditions in vivo and it is likely that some components are produced solely in this environment. These are therefore potential vaccine components, which could not be discovered by previous techniques.

One of the most important developments in recent medical history is the development of vaccines which provide prophylactic protection from a wide variety of pathogenic organisms. Many vaccines are produced by inactivated or attenuated pathogens which are injected into an individual. The immunised individual responds by producing both a humoral (antibody) and cellular (cytolytic T cells, CTL's) response. For example, hepatitis vaccines are made by heat inactivating the virus and treating it with a cross linking agent such as formaldehyde. An example of an attenuated pathogen useful as a vaccine is represented by polio vaccines which are produced by attenuating a live pathogen.

However the use of attenuated organisms in vaccines for certain diseases is problematic due to the lack of knowledge regarding the pathology of the condition and the nature of the attenuation. For certain viral agents this is a particular problem since viruses, in particular retroviruses, have an error prone replication cycle which results viable mutations in the genes which comprise the virus. This can result in alterations to antigenic determinants which have previously been used as vaccines. An alternative to the use of inactivated or attenuated pathogens is the identification of pathogen epitopes to which the immune system is particularly sensitive. In this regard many pathogenic toxins produced by pathogenic organisms during an infection are particularly useful in the development of vaccines which protect the individual from a particular pathogenic organism.

The development of so-called subunit vaccines (vaccines in which the inmmunogen is a fragment or subunit of a protein or complex expressed by a particular pathogenic organism) has been the focus of considerable medical research. The need to identify candidate molecules useful in the development of subunit vaccines is apparent not least because conventional chemotherapeutic approaches to the control of pathogenic organisms has more recently been stymied by the development of antibiotic resistance. A number of methods have been developed to identify potential antigenic polypeptides which can be used as a vaccine. One such method is disclosed herein.

It has been known for many years that tumour cells produce a number of tumour cell specific antigens, some of which are presented at the tumour cell surface. The immune system recognises these antigens as foreign thereby resulting in the production of antibodies to self antigens, so called autoantibodies or autologous antisera.

One such technique is Serological identification of antigens by recombinant Expression Cloning, abbreviated to SEREX.

Typically, the technique involves the extraction of RNA from tumour tissue followed by the selective enrichment of mRNA from the isolated total RNA. The mRNA is reverse transcribed into cDNA using viral reverse transcriptase. The cDNA thus synthesised is subcloned into an expression vector and transformed into an appropriate bacterial strain. The transformed bacteria are plated onto a suitable nutrient agar and under appropriate growth conditions the subcloned cDNA is expressed from the expression vector in the bacterial cell. The cells are lysed naturally by the use of phage based expression vectors, for example λ phage or phagemid based vectors, which through their lytic cycle cause cell lysis. The released polypeptides are transferred to a suitable membrane support (i.e. nitrocellulose, nylon) and exposed to autologous antisera from the patient from which the tumour tissue was originally isolated. The immunoscreening methodology allows the identification of genes that are over expressed or inappropriately expressed in a selected tumour tissue from a patient.

We have exploited this technique to identify antigenic polypeptides expressed by pathogenic organisms during an infection. Autologous antisera produced during the infection is used to screen an expression library created from genomic DNA to identify and clone antigens.

In its broadest aspect the invention relates to the identification of antigenic polypeptides expressed during an infection by a pathogenic microbe and their use in vaccination.

According to a first aspect of the invention there is provided a method to identify opsonic antigens expressed by pathogenic organisms comprising:

(i) providing a nucleic acid library encoding genes or partial gene sequences of a pathogenic organism;
(ii) transforming/transfecting said library into a host cell;
(iii) providing conditions conducive to the expression of said transformed/transfected genes or partial gene sequences;
(iv) contacting the antigens expressed by the genes/partial gene sequences with autologous antisera derived from an animal infected with, or has been infected with, said pathogenic organism;
(v) purifying the nucleic acid encoding the antigens or partial antigenic polypeptides binding to said autologous antisera; and
(vi) testing the opsonic activity of a polypeptide encoded by said DNA molecule.

In a preferred method of the invention said library comprises genomic DNA of a pathogenic organism.

Ideally said pathogenic organism is bacterial.

More preferably still said bacterial organism is selected from the following: *Staphylococcus aureus*; *Staphylococcus epidermidis*; *Enterococcus faecalis*; *Mycobacterium tuberculsis*; *Streptococcus* group B; *Streptoccocus pneumoniae*; *Helicobacter pylori*; *Neisseria gonorrhea*; *Streptococcus* group A; *Borrelia burgdorferi*, *Coccidiodes immitis*; *Histoplasma sapsulatum*; *Neisseria meningitidis* type B; *Shigella flexneri*; *Escherichia coli*; *Haemophilus influenzae*.

Preferably still said pathogenic organism is of the genus *Staphylococcus* spp. Ideally organism is *Staphylococcus aureus* or *Staphylococcus epidermidis*.

In a further preferred embodiment of the invention said nucleic acid library is a lambda library, ideally a lambda expression library.

According to a second aspect of the invention there is provided a nucleic acid molecule comprising a DNA sequence selected from:

(i) the DNA sequence as represented by the DNA sequences herein disclosed in Table 7 or Table 9;
(ii) DNA sequences which hybridise to the sequences identified in (i) above which encode a polypeptide expressed by a pathogenic organism and
(iii) DNA sequences which are degenerate as a result of the genetic code to the DNA sequences defined in (i) and (ii).

In a yet still further preferred embodiment of the invention said nucleic acid molecule is genomic DNA.

In a preferred embodiment of the invention there is provided an isolated nucleic acid molecule which anneals under stringent hybridisation conditions to the sequences herein disclosed.

Stringent hybridisation/washing conditions are well known in the art. For example, nucleic acid hybrids that are stable after washing in 0.1×SSC, 0.1% SDS at 60° C. It is well known in the art that optimal hybridisation conditions can be calculated if the sequences of the nucleic acid is known. For example, hybridisation conditions can be determined by the GC content of the nucleic acid subject to hybridisation. Please see Sambrook et al (1989) Molecular Cloning; A Laboratory Approach. A common formula for calculating the stringency conditions required to achieve hybridisation between nucleic acid molecules of a specified homology is:

$$T_m = 81.5° C. + 16.6 \text{ Log } [Na^+] + 0.41 [\% G+C] - 0.63 (\% \text{ formamide}).$$

According to a third aspect of the invention there is provided at least one polypeptide identified by the method according to the invention.

In a preferred embodiment of the invention, said polypeptide is associated with infective pathogenicity of an organism according to any previous aspect or embodiment of the invention.

More preferably still said polypeptide is at least one, or part thereof, of the amino acid sequences represented in Tables 8 or Table 10.

In an alternative preferred embodiment of the invention said polypeptide carries a non-protein antigen, for example a polysaccharide antigen.

According to a fourth aspect of the invention there is provided a nucleic acid molecule characterised in that said nucleic acid molecule is part of a vector adapted to facilitate recombinant expression of the polypeptide encoded by said nucleic acid molecule.

In a preferred embodiment of the invention said vector is an expression vector adapted for prokaryotic gene expression. Alternatively said expression vector is adapted for eukaryotic gene expression.

Typically said adaptation includes, by example and not by way of limitation, the provision of transcription control sequences (promoter sequences) which mediate cell specific expression. These promoter sequences may be cell specific, inducible or constitutive.

Promoter is an art recognised term and, for the sake of clarity, includes the following features which are provided by example only, and not by way of limitation. Enhancer elements are cis acting nucleic acid sequences often found 5' to the transcription initiation site of a gene (enhancers can also be found 3' to a gene sequence or even located in intronic sequences and is therefore position independent). Enhancers function to increase the rate of transcription of the gene to which the enhancer is linked. Enhancer activity is responsive to trans acting transcription factors (polypeptides) which have been shown to bind specifically to enhancer elements. The binding/activity of transcription factors (please see Eukaryotic Transcription Factors, by David S Latchman, Academic Press Ltd, San Diego) is responsive to a number of environmental cues which include, by example and not by way of limitation, intermediary metabolites (eg glucose, lipids), environmental effectors (eg light, heat,).

Promoter elements also include so called TATA box and RNA polymerase initiation selection (RIS) sequences which function to select a site of transcription initiation. These sequences also bind polypeptides which function, inter alia, to facilitate transcription initiation selection by RNA polymerase.

Adaptations also include the provision of selectable markers and autonomous replication sequences which both facilitate the maintenance of said vector in either the eukaryotic cell or prokaryotic host. Vectors which are maintained autonomously are referred to as episomal vectors.

Adaptations which facilitate the expression of vector encoded genes include the provision of transcription termination/polyadenylation sequences. This also includes the provision of internal ribosome entry sites (IRES) which function to maximise expression of vector encoded genes arranged in bicistronic or multi-cistronic expression cassettes.

These adaptations are well known in the art. There is a significant amount of published literature with respect to expression vector construction and recombinant DNA techniques in general. Please see, Sambrook et al (1989) Molecular Cloning: A Laboratory Manual, Cold Spring Harbour Laboratory, Cold Spring Harbour, N.Y. and references therein; Marston, F (1987) DNA Cloning Techniques: A Practical Approach Vol III IRL Press, Oxford UK; DNA Cloning: F M Ausubel et al, Current Protocols in Molecular Biology, John Wiley & Sons, Inc. (1994).

According to yet a further aspect of the invention there is provided a method for the production of the polypeptides according to any previous aspect or embodiment of the invention comprising:

(i) providing a cell transformed/transfected with a vector according to the invention;

(ii) growing said cell in conditions conducive to the manufacture of said polypeptides; and (iii) purifying said polypeptide from said cell, or its growth environment.

In a preferred method of the invention said vector encodes, and thus said recombinant polypeptide is provided with, a secretion signal to facilitate purification of said polypeptide.

According to a fifth aspect of the invention there is provided a cell or cell-line transformed or transfected with the vector according to the invention.

In a preferred embodiment of the invention said cell is a prokaryotic cell. Alternatively said cell is a eukaryotic cell selected from: fungal, insect, amphibian; mammalian; plant.

According to a yet further aspect of the invention there is provided a vaccine comprising at least one antigen or antigenic polypeptide according to the invention.

Ideally said vaccine further comprises a carrier and/or adjuvant.

The terms adjuvant and carrier are construed in the following manner. Some polypeptide or peptide antigens contain B-cell epitopes but no T cell epitopes. Immune responses can be greatly enhanced by the inclusion of a T cell epitope in the polypeptide/peptide or by the conjugation of the polypeptide/peptide to an immunogenic carrier protein such as key hole limpet haemocyanin or tetanus toxoid which contain multiple T cell epitopes. The conjugate is taken up by antigen presenting cells, processed and presented by human leukocyte antigens (HLA's) class II molecules. This allows T cell help to be given by T cell's specific for carrier derived epitopes to the B cell which is specific for the original antigenic polypeptide/peptide. This can lead to increase in antibody production, secretion and isotype switching.

An adjuvant is a substance or procedure which augments specific immune responses to antigens by modulating the activity of immune cells. Examples of adjuvants include, by example only, agonsitic antibodies to co-stimulatory molecules, Freunds adjuvant, muramyl dipeptides, liposomes. An adjuvant is therefore an immunomodulator. A carrier is an immunogenic molecule which, when bound to a second molecule augments immune responses to the latter.

In yet a further aspect of the invention there is provided a method to immunise an animal against a pathogenic microbe comprising administering to said animal at least one polypeptide, or part thereof, according to the invention or the vaccine according to the invention.

In a preferred method of the invention said animal is human.

Preferably the vaccine, or antigenic polypeptide, can be delivered by direct injection either intravenously, intramuscularly, subcutaneously. Further still, the vaccine or antigenic polypeptide, may be taken orally.

Preferably the vaccine is against the bacterial species *Staphylococcus aureus*.

The vaccine may also be against the bacterial species *Staphylococcus epidermidis*.

It will also be apparent that vaccines or antigenic polypeptides are effective at preventing or alleviating conditions in animals other than humans, for example and not by way of limitation, family pets, livestock, horses.

According to a further aspect of the invention there is provided an antibody, or at least an effective binding part thereof, which binds at least one antigen or antigenic polypeptide according to the invention.

In a preferred embodiment of the invention said antibody is a polyclonal or monoclonal antibody wherein said antibody is specific to said polypeptide.

Alternatively, said antibody is a chimeric antibody produced by recombinant methods to contain the variable region of said antibody with an invariant or constant region of a human antibody.

In a further alternative embodiment of the invention, said antibody is humanised by recombinant methods to combine the complimentarity determining regions of said antibody with both the constant (C) regions and the framework regions from the variable (V) regions of a human antibody.

Preferably said antibody is provided with a marker including a conventional label or tag, for example a radioactive and/or fluorescent and/or epitope label or tag.

Preferably said humanised monoclonal antibody to said polypeptide is produced as a fusion polypeptide in an expression vector suitably adapted for transfection or transformation of prokaryotic or eukaryotic cells.

Antibodies, also known as immunoglobulins, are protein molecules which have specificity for foreign molecules (antigens). Immunoglobulins (Ig) are a class of structurally related proteins consisting of two pairs of polypeptide chains, one pair of light (L) (low molecular weight) chain (κ or λ), and one pair of heavy (H) chains (γ, α, μ, δ and ε), all four linked together by disulphide bonds. Both H and L chains have regions that contribute to the binding of antigen and that are highly variable from one Ig molecule to another. In addition, H and L chains contain regions that are non-variable or constant.

The L chains consist of two domains. The carboxy-terminal domain is essentially identical among L chains of a given type and is referred to as the "constant" (C) region. The amino terminal domain varies from L chain to L chain and contributes to the binding site of the antibody. Because of its variability, it is referred to as the "variable" (V) region.

The H chains of Ig molecules are of several classes, α, μ, σ, α, and γ (of which there are several sub-classes). An assembled Ig molecule consisting of one or more units of two identical H and L chains, derives its name from the H chain that it possesses. Thus, there are five Ig isotypes: IgA, IgM, IgD, IgE and IgG (with four sub-classes based on the differences in the H chains, i.e., IgG1, IgG2, IgG3 and IgG4). Further detail regarding antibody structure and their various functions can be found in, Using Antibodies: A laboratory manual, Cold Spring Harbour Laboratory Press.

Chimeric antibodies are recombinant antibodies in which all of the V-regions of a mouse or rat antibody are combined with human antibody C-regions. Humanised antibodies are recombinant hybrid antibodies which fuse the complimentarity determining regions from a rodent antibody V-region with the framework regions from the human antibody V-regions. The C-regions from the human antibody are also used. The complimentarity determining regions (CDRs) are the regions within the N-terminal domain of both the heavy and light chain of the antibody to where the majority of the variation of the V-region is restricted. These regions form loops at the surface of the antibody molecule. These loops provide the binding surface between the antibody and antigen.

Antibodies from non-human animals provoke an immune response to the foreign antibody and its removal from the circulation. Both chimeric and humanised antibodies have reduced antigenicity when injected to a human subject because there is a reduced amount of rodent (i.e. foreign) antibody within the recombinant hybrid antibody, while the human antibody regions do not illicit an immune response. This results in a weaker immune response and a decrease in the clearance of the antibody. This is clearly desirable when using therapeutic antibodies in the treatment of human diseases. Humanised antibodies are designed to have less "foreign" antibody regions and are therefore thought to be less immunogenic than chimeric antibodies.

In a further preferred embodiment of the invention said antibodies are opsonic antibodies.

Phagocytosis is mediated by macrophages and polymorphic leukocytes and involves the ingestion and digestion of micro-organisms, damaged or dead cells, cell debris, insoluble particles and activated clotting factors. Opsonins are agents which facilitate the phagocytosis of the above foreign bodies. Opsonic antibodies are therefore antibodies which provide the same function. Examples of opsonins are the Fc portion of an antibody or compliment C3.

In another aspect of the invention there is provided a vector which is adapted for the expression of the humanised or chimeric antibodies according to the invention.

In a yet further aspect of the invention, there is provided a cell or cell line which has been transformed or transfected with the vector encoding the humanised or chimeric antibody according to the invention.

In a yet further aspect of the invention there is provided a method for the production of the humanised or chimeric antibody according to the invention comprising:
(i) providing a cell transformed or transfected with a vector which comprises a nucleic acid molecule encoding the humanised or chimeric antibody according to the invention;
(ii) growing said cell in conditions conducive to the manufacture of said antibody; and
(iii) purifying said antibody from said cell, or its growth environment.

In a yet further aspect of the invention there is provided a hybridoma cell line which produces a monoclonal antibody as hereinbefore described.

In a further aspect of the invention there is provided a method of producing monoclonal antibodies according to the invention using hybridoma cell lines according to the invention.

In a further aspect of the invention there is provided a method for preparing a hybridoma cell-line producing monoclonal antibodies according to the invention comprising the steps of:
i) immunising an immunocompetent mammal with an immunogen comprising at least one polypeptide having the amino acid sequence as represented in Table 8 or 10, or fragments thereof;
ii) fusing lymphocytes of the immunised immunocompetent mammal with myeloma cells to form hybridoma cells;
iii) screening monoclonal antibodies produced by the hybridoma cells of step (ii) for binding activity to the amino acid sequences of (i);
iv) culturing the hybridoma cells to proliferate and/or to secrete said monoclonal antibody; and
v) recovering the monoclonal antibody from the culture supernatant.

Preferably, the said immunocompetent mammal is a mouse. Alternatively, said immunocompetent mammal is a rat.

The production of monoclonal antibodies using hybridoma cells is well-known in the art. The methods used to produce monoclonal antibodies are disclosed by Kohler and Milstein in Nature 256, 495-497 (1975) and also by Donillard and Hoffinan, "Basic Facts about Hybridomas" in Compendium of Immunology V.II ed. by Schwartz, 1981, which are incorporated by reference.

In a further aspect of the invention there is provided the use of the antibodies for manufacture of a medicament for the treatment of *Staphylococcus aureus*-associated septicaemia, food-poisoning or skin disorders.

In another aspect of the invention there is provided the use of the antibodies according to the invention for the manufacture of a medicament for the treatment of *Staphylococcus epidermidis*-associated septicaemia, peritonitis or endocarditis.

It will be apparent that the polypeptides identified by the method according to the invention will facilitate the production of therapeutic antibodies to a range of diseases resulting from pathogenic infection, for example, septicaemia; tuberculosis; bacteria-associated food poisoning; blood infections; peritonitis; endocarditis; sepsis; meningitis; pneumonia; stomach ulcers; gonorrhoea; strep throat; streptococcal-associated toxic shock; necrotizing fasciitis; impetigo; histoplasmosis; Lyme disease; gastro-enteritis; dysentery; shigellosis.

As has already been stated earlier, microbial organisms cause a wide variety of diseases. Listed below, and not by way of limitation, are a number of micro-organisms and some of the diseases they cause.

| Micro-organism | Disease(s) caused |
| --- | --- |
| *Staphylococcus aureus* | Sepsis, food poisoning, septicaemia, |
| *Staphylococcus epidermidis* | Peritonitis, septicaemia, endocarditis, other hospital-associated diseases |
| *Enterococcus faecalis* | Endocarditis, cystitis, wound infections |
| *Mycobacterium tuberculosis* | Tuberculosis |
| *Streptococcus* group B | Sepsis, meningitis, pneumonia, bladder infections |
| *Streptococcus pneumoniae* | Pneumonia, meningitis |
| *Helicobacter pylori* | Stomach ulcers |
| *Neisseria gonorrhoea* | Gonorrhoea |
| *Streptococcus* group A | Strep throat, necrotizing fasciitis, impetigo, Strep. Toxic shock syndrome |
| *Borrelia burgdoferi* | Lyme disease |
| *Coccidiodes immitis* | Pneumonia |
| *Histoplasma sapsulatum* | Histoplasmosis, pneumonia |
| *Neisseria meningitidis* type B | Meningitis |
| *Shigella flexneri* | Gastro-enteritis, shigellosis, dysentry |
| *Escherichia coli* | Food-poisoning, gastro-enteritis |
| *Haemophilus influenzae* | Meningitis, pneumonia, arthritis, cellulitis |

An embodiment of the invention will now be described by example only and with reference to the following materials, methods and tables:

Table 1 illustrates the immunization and bleed schedule for production of monoclonal antibodies reactive with peptide Hex A;

Table 2 illustrates an immunoassay of sera from mice immunized with peptide Hex A;

Table 3 illustrates an immunoassay of supernatants from anti-Hex A hybridoma supernatants;

Table 4 illustrates the immunization and bleed schedule for production of monoclonal antibodies reactive with peptide 29 kDa peptide;

Table 5 illustrates an immunoassay of day 98 sera from mice immunized with peptide 29 kDa;

Table 6 illustrates an immunoassay of supernatants from anti-29 kDa hybridomas supernatants from T75 Culture Flasks;

Table 7 represents the DNA sequences of *S. aureaus* partial gene sequences identified by the screening method;

Table 8 represents the protein sequences encoded by the DNA sequences illustrated in Table 7;

Table 9 represents the DNA sequences of *S. epidermidis* partial gene sequences identified by the screening method; and Table 10 represents the protein sequences of the DNA sequences illustrated in Table 9.

Materials and Methods

Screening Genomic Libraries of *S. aureus* and *S. epidermidis*

A λZAP Express library of genomic DNA of *S. aureus* 8325/4 and *S. epidermidis* was used. It contains fragments of 2-10 kb from a partial Sau3A digest of total genomic DNA. This was cloned into the BamH1 site of the vector. The library contains >10× coverage of the genome. The library was probed by plaque lift using an initial screen of approximately 20,000 plaque forming units on a 9 cm diameter Petri dish. The plating cells used, their treatment, the plating procedure and buffers were exactly as described in the manufacturers handbook (Stratagene). Plating cells, *Escherichia coli* XL1-Blue MRF', were infected with phage and plated in 3 ml top LB agar containing 10 mM $MgSO_4$ onto LB plates containing 10 mM $MgSO_4$. The plates were then incubated at 42° C. for 4 hr. An 8.5 cm diameter nitrocellulose filter disc (previously soaked in 10 mM IPTG and air-dried) was placed on each plate and its location marked. The plates were then incubated for a further 3.5 hr at 37° C. The filters were removed and washed in TBST buffer before blocking overnight at 4° C. in TBST containing 6% w/v dried skimmed milk and 3% v/v pig serum (Sigma). The serum was used to block any Protein A clones on the filter. The filters are then treated with patient serum (1/5000 dilution) in blocking solution for 90 min at room temperature. Antisera have been obtained from patients convalescing from major *S. aureus* infections. The filters are then washed for 3×10 min in TBST. Secondary antibody used was goat anti-human whole IgG alkaline phosphatase linked (Sigma) at 1/30,000 dilution in blocking solution at room temperature for 30 min. The filters were then washed as above and developed using a standard colorimetric procedure.

Cross-reactive plaques were located on the agar plates and cored into 0.2 ml phage buffer with 0.02 ml chloroform. The titre of each core stock was determine and the phage plated at approximately 200 plaques per plate. A plaque lift and screen was performed as above to give single, pure cross-reactive clones.

The pure clones were then spotted (1 µl) onto plates to give a confluent plaque of 0.5 cm diameter. 30 individual clones can be spotted on each plate. A plaque lift is performed and the filter probed with an appropriate sera. In this way clones can be tested for their cross-reactivity with other patient sera, non-infected donor sera and anti-Protein A sera.

Individual clones were then excised to give a phagemid in *E. coli* XLOLR using the manufacturers protocol (Stratagene). A plasmid miniprep of each was carried out and the size of the genomic insert determined by restriction mapping. The identity of the cloned insert was determined by DNA sequencing using primers against vector sequence, which allows sequencing across the insert. By comparison of the derived sequence against the public domain databases the nature of the cloned gene(s) can be determined.

Hybridisation Solutions/Conditions

Typically, hybridisation conditions uses 4-6×SSPE (20× SSPE contains 175.3 g NaCl, 88.2 g $NaH_2PO_4H_2O$ and 7.4 g EDTA dissolved to 1 litre and the pH adjusted to 7.4); 5-10× Denhardts solution (50× Denhardts solution contains 5 g Ficoll (type 400, Pharmacia), 5 g polyvinylpyrrolidone abd 5 g bovine serum albumen; 100 µg-1.0 mg/ml sonicated salmon/herring DNA; 0.1-1.0% sodium dodecyl sulphate; optionally 40-60% deionised formamide. Hybridisation temperature will vary depending on the GC content of the nucleic acid target sequence but will typically be between 42°-65°.

Mouse Model for Testing Candidate Vaccine Polypeptides

Mice are injected intravenously with $5\times10^7$ S. aureus and mortality, bacteremia and abscess formation is monitored over the ensuing 7 days. At this dose 100% of the mice are bacteremic for greater than 4 days, 100% have detectable abscess formation in liver and kidney and greater than 80% of mice die within four days. At lower doses of injected organisms, bacteremia is detectable in the absence of death.

Immunization Program

Single proteins are injected at a dose of 10-100 μg per mouse in RIBI adjuvant, boosted 14 and 28 days later and bled 14 and 28 days thereafter for evaluation of antibodies in their sera using ELISA. When groups of proteins are injected the final amount of each protein will be 10 ug per mouse and the above immunization scheme will be followed.

Evaluation of Protective Efficacy of Single or Groups of Proteins

We will employ the mouse infection model described above to evaluate the protective efficacy of the proteins that are being tested. To this end groups of 5 mice will be immunized with single proteins or pools of 5 proteins as described above. We will monitor antibody titers to the injected proteins and when high titers are reached we will inoculate mice with S. aureus at high and low dose. Control mice that have not been immunized or that were immunized with adjuvant only will also be inoculated with S. aureus. We will measure levels of bacteremia, abscess formation and survival in all groups. All parameters of infection will be suppressed in mice that have high circulating levels of protective antibodies. If we find a pool of proteins that induces protection we will compare the protection induced by the individual components to that induced by the pool of proteins to see if protection was induced by a single protein or by the combined action of antibodies to multiple proteins. Using this approach we will identify protein epitopes that are protective.

In addition to using the in vivo model of mouse infection we will also obtain the sera from mice that are injected as above and monitor their sera for opsonophagocytic activity using a complement dependent system in the presence of human polymorphonuclear lymphocytes. This assay is well known in the art. This assay has been used an in vitro surrogate for measuring protective efficacy of antibody. Spleens from mice that have opsonophagocytic antibodies will then be used as fusion partners in an attempt to make monoclonal antibodies that are reactive with S. aureus.

Using this multipronged approaches we will have a high level of confidence that we can identify protective epitopes that can be used either in a vaccine construct or that can be used to generate monoclonal antibodies.

EXAMPLE 1

Immunoassay for Detection of Antibodies Reactive with Peptide Hex A

The binding of mouse sera or MAbs to Hex A was measured by immunoassay on wells coated with Hex A. One hundred microliters of a 250-500 ng/ml solution of Hex A in PBS was distributed into replicate Nunc Maxisorp Stripwells and incubated overnight at room temperature. The unbound material was removed from the wells by washing four times with PBS-T. Unbound antigen was removed from the plate by washing four times with PBS-T. Antibody, diluted in PBS-T, was then added to the wells and incubated at room temperature for 30-60 minutes. After addition of the antibody, the wells were incubated at room temperature for 30-60 minutes in a draft-free environment. The wells were again washed four times with PBS-T and ninety-five microliters of detection antibody was then added to each well. The detection antibody was either peroxidase-labeled goat anti-mouse IgG (gamma-specific), diluted 1:10000 in PBS-T, or peroxidase-labeled rabbit anti-mouse $IgG_1$, diluted 1:6000 in PBS-T.

Following another 30-60 minute incubation at room temperature, the wells were washed four times with PBS-T and each well received 100 μl of TMB substrate solution (BioFx #TMBW-0100-01). Plates were incubated in the dark at room temperature for 15 minutes and the binding reactions were stopped by the addition of 100 μl of TMB stop solution (BioFx #STPR-0100-01). The absorbance of each well was measured at 450 nm using a Molecular Devices Vmax plate reader.

Isotype was determined using a mouse immunoglobulin isotype kit obtained from Zymed Laboratories (Cat. No. 90-6550).

Immunization of Mice for Production of Monoclonal Antibodies Reactive with Peptide Hex A.

Five female BALB/c mice, approximately 8 weeks of age, were immunized with Hex A according to the schedule described in Table 1. All immunizations were administered subcutaneously in 50% RIBI adjuvant. Sera from the mice were tested by immunoassay, and based on the results of the assay described in Table 2, mouse 2021 was selected for hybridoma production. Mouse 2021 received a booster immunization of 32.5 ug of Hex A in PBS, administered intraperitoneally, three days prior to the production of hybridomas.

TABLE 1

Immunization and Bleed Schedule for Production of Monoclonal Antibodies Reactive with Peptide Hex A

| Experimental Day | Boost (ug/mouse) | Adjuvant | Bleed |
| --- | --- | --- | --- |
| 0 | 10 ug | RIBI | Yes |
| 34 | 8.3 | RIBI | Yes |
| 48 | None | | Yes |
| 60 | 25 ug | RIBI | Yes |
| 74 | None | | Yes |
| 98 | 25 ug | RIBI | Yes |
| 124 | None | | Yes |

TABLE 2

Immunoassay of Sera from Mice Immunized with Peptide Hex A

| Serum Dilution | 2021 | 2022 | 2023 | 2024 | 2025 |
| --- | --- | --- | --- | --- | --- |
| 1000 | 3.553 | 3.569 | 3.226 | 3.336 | 3.439 |
| 3000 | 2.803 | 2.538 | 2.357 | 2.575 | 2.403 |
| 9000 | 1.663 | 1.336 | 1.314 | 1.522 | 1.357 |
| 27000 | 0.793 | 0.618 | 0.622 | 0.716 | 0.598 |
| Buffer | 0.095 | 0.078 | 0.145 | 0.066 | 0.089 |

Preparation of Hybridomas Reactive with Hex A Peptide

Hybridomas were prepared by the general methods of Shulman, Wilde and Kohler and Bartal and Hirshaut (34, 48). Mouse 2021 was selected for hybridoma production based on the results of an immunoassay and received a booster immunization of 32.5 ug of antigen three days prior to sacrifice. Spleenocytes from mouse 2028 were isolated and mixed with mouse myeloma cells SP2/0 (ATCC Catalog number CRL 1581) at a ratio of 10 spleenocytes:1 myeloma. The cells were pelleted by centrifugation (400×g, 10 minutes at room temperature) and washed in serum free medium. The supernatant was removed to near-dryness and fusion of the cell mixture was accomplished in a sterile 50 ml centrifuge conical by the addition of 1 ml of warm (37° C.) polyethylene glycol (PEG; mw 1400; Boehringer Marnheim) over a period of 60-90 seconds. The PEG was diluted by slow addition of serum-free medium in successive volumes of 1, 2, 4, 8, 16 and 19 mls. The hybridoma cell suspension was gently resuspended into the medium and the cells pelleted by centrifugation (500×g, 10 minutes at room temperature). The supernatant was removed and the cells resuspended in medium RPMI 1640, supplemented with 15% heat-inactivated fetal bovine serum, 0.05 mM hypoxanthine and 16 µM thymidine (HT medium). One hundred µl of the hybridoma cells were planted into 952 wells of 96-well tissue culture plates. Eight wells (column 1 of plate A) received approximately $2.5 \times 10^4$ SP/20 cells in 100 µl. The SP/20 cells served as a control for killing by the selection medium added 24 hours later.

Twenty four hours after preparation of the hybridomas, 100 µl of RPMI 1640, supplemented with 15% heat-inactivated fetal bovine serums, 0.1 mM hypoxanthine, 0.8 µM aminopterin and 32 µM thymidine (HAT medium) was added to each well. Ninety-six hours after the preparation of the hybridomas, the SP/20 cells in plate A, column 1 appeared to be dead, indicating that the HAT selection medium had successfully killed the unfused SP/20 cells.

Ten days after the preparation of the hybridomas, supernatants from all wells were tested by ELISA for the presence of antibodies reactive with peptide Hex A. Based on the results of this preliminary assay, cells from three wells were transferred to a 24-well culture dish and expanded. Supernatants from these cultures were retested by ELISA for the presence of antibodies that bind to peptide Hex A.

Using IgG-1-specific detection, the absorbance values obtained with the supernatants from hybridonia culture 02-101FE1, 02-101ED8 and 02-100JC10 were 2.150, 2.230 and 2.574, respectively, compared to an absorbance of 0.044 with buffer alone (Table 3). Absorbances were lower, but still positive, with gamma-specific detection (Table 3). Each of the cultures was expanded, cryopreserved and cloned by limiting dilution. Two-three clones of each culture were expanded and cryopreserved for future evaluation.

TABLE 3

Immunoassay of Supernatants
from Anti-Hex A Hybridoma Supernatants

| Culture ID | Dilution | Detection With Anti-Mouse IgG-1 | Detection With Anti-Mouse Gamma |
|---|---|---|---|
| 02-101FE1 | 2 | 2.150 | 0.941 |
| 02-101JC10 | 2 | 2.574 | 1.403 |
| 02-101ED8 | 2 | 2.238 | 1.174 |
| Buffer |  | 0.044 | 0.073 |

EXAMPLE 2

Immunoassay for Detection of Antibodies Reactive with Peptide 29 kDa

The binding of mouse sera or MAbs to 29 kDa was measured by immunoassay on wells coated with 29 kDa. One hundred microliters of a 500-1000 ng/ml solution of 29 kDa in PBS was distributed into replicate Nunc Maxisorp Stripwells and incubated overnight at room temperature. The unbound material was removed from the wells by washing four times with PBS-T. Unbound antigen was removed from the plate by washing four times with PBS-T. Antibody, diluted in PBS-T, was then added to the wells and incubated at room temperature for 30-60 minutes. After addition of the antibody, the wells were incubated at room temperature for 30-60 minutes in a draft-free environment. The wells were again washed four times with PBS-T and ninety-five microliters of detection antibody was then added to each well. The detection antibody was either peroxidase-labeled goat anti-mouse IgG (gamma-specific), diluted 1:10000 in PBS-T, or peroxidase-labeled rabbit anti-mouse $IgG_1$, diluted 1:6000 in PBS-T.

Following another 30-60 minute incubation at room temperature, the wells were washed four times with PBS-T and each well received 100 µl of TMB substrate solution (BioFx #TMBW-0100-01). Plates were incubated in the dark at room temperature for 15 minutes and the binding reactions were stopped by the addition of 100 µl of TMB stop solution (BioFx #STPR-0100-01). The absorbance of each well was measured at 450 nm using a Molecular Devices Vmax plate reader.

Isotype was determined using a mouse immunoglobulin isotype kit obtained from Zymed Laboratories (Cat. No. 90-6550).

Immunoassay for Detection of Antibodies Reactive with Peptide 29 kDa

The binding of mouse sera or MAbs to 29 kDa was measured by immunoassay on wells coated with 29 kDa. One hundred microliters of a 500-1000 ng/ml solution of 29 kDa in PBS was distributed into replicate Nunc Maxisorp Stripwells and incubated overnight at room temperature. The unbound material was removed from the wells by washing four times with PBS-T. Unbound antigen was removed from the plate by washing four times with PBS-T. Antibody, diluted in PBS-T, was then added to the wells and incubated at room temperature for 30-60 minutes. After addition of the antibody, the wells were incubated at room temperature for 30-60 minutes in a draft-free environment. The wells were again washed four times with PBS-T and ninety-five microliters of detection antibody was then added to each well. The detection antibody was either peroxidase-labeled goat anti-mouse IgG (gamma-specific), diluted 1:10000 in PBS-T, or peroxidase-labeled rabbit anti-mouse $IgG_1$, diluted 1:6000 in PBS-T.

Following another 30-60 minute incubation at room temperature, the wells were washed four times with PBS-T and each well received 100 µl of TMB substrate solution (BioFx #TMBW-0100-01). Plates were incubated in the dark at room temperature for 15 minutes and the binding reactions were stopped by the addition of 100 µl of TMB stop solution (BioFx #STPR-0100-01). The absorbance of each well was measured at 450 nm using a Molecular Devices Vmax plate reader.

Isotype was determined using a mouse immunoglobulin isotype kit obtained from Zymed Laboratories (Cat. No. 90-6550).

Immunization of Mice for Production of Monoclonal Antibodies Reactive with Peptide 29 KDa Five female BALB/c mice, approximately 8 weeks of age, were immunized with 29 KDa according to the schedule described in Table 1. All immunizations were administered subcutaneously in 50% RIBI adjuvant. Sera from the mice were tested by immunoassay, and based on the results of the assay described in Table 2, mouse 2028 was selected for hybridoma production. Mouse 2028 received a booster immunization of 50 ug of 29 KDa in PBS, administered intraperitoneally, three days prior to the production of hybridomas.

TABLE 4

Immunization and Bleed Schedule for Production of Monoclonal Antibodies Reactive with Peptide 29 kDa

| Experimental Day | Boost (ug/mouse) | Adjuvant | Bleed |
|---|---|---|---|
| 0 | 10 ug | RIBI | Yes |
| 34 | 10 ug | RIBI | Yes |
| 48 | None | | Yes |
| 60 | 20 ug | RIBI | Yes |
| 74 | None | | Yes |
| 98 | 20 ug | RIBI | Yes |

TABLE 5

Immunoassay of Day 98 Sera from Mice Immunized with Peptide 29 kDa

| Mouse ID | Sera at 1:1000 | Sera at 1:10000 |
|---|---|---|
| 2026 | 0.260 | 0.078 |
| 2027 | 1.415 | 0.306 |
| 2028 | 2.184 | 0.383 |
| 2029 | 0.838 | 0.107 |
| 2030 | 1.073 | 0.154 |
| Buffer | 0.061 | |

Preparation of Hybridomas Reactive with 29 KDa Peptide

Hybridomas were prepared by the general methods of Shulman, Wilde and Kohler and Bartal and Hirshaut (34, 48). Mouse 2028 was selected for hybridoma production based on the results of an immunoassay and received a booster immunization of 50 ug of antigen three days prior to sacrifice. Spleenocytes from mouse 2028 were isolated and mixed with mouse myeloma cells P3X63Ag8.653 (ATCC Catalog number CRL 1580) at a ratio of 10 spleenocytes:1 myeloma. The cells were pelleted by centrifugation (400×g, 10 minutes at room temperature) and washed in serum free medium. The supernatant was removed to near-dryness and fusion of the cell mixture was accomplished in a sterile 50 ml centrifuge conical by the addition of 1 ml of warm (37° C.) polyethylene glycol (PEG; mw 1400; Boehringer Mannheim) over a period of 60-90 seconds. The PEG was diluted by slow addition of serum-free medium in successive volumes of 1, 2, 4, 8, 16 and 19 mls. The hybridoma cell suspension was gently resuspended into the medium and the cells pelleted by centrifugation (500×g, 10 minutes at room temperature). The supernatant was removed and the cells resuspended in medium RPMI 1640, supplemented with 15% heat-inactivated fetal bovine serum, 0.05 mM hypoxanthine and 16 µM thymidine (HT medium). One hundred µl of the hybridoma cells were planted into 952 wells of 96-well tissue culture plates. Eight wells (column 1 of plate A) received approximately $2.5 \times 10^4$ P3X63Ag8.653 cells in 100 µl. The P3X63Ag8.653 cells served as a control for killing by the selection medium added 24 hours later.

Twenty four hours after preparation of the hybridomas, 100 µl of RPMI 1640, supplemented with 15% heat-inactivated fetal bovine serums, 0.1 mM hypoxanthine, 0.8 µM aminopterin and 32 µM thymidine (HAT medium) was added to each well. Ninety-six hours after the preparation of the hybridomas, the P3X63Ag8.653 cells in plate A, column 1 appeared to be dead, indicating that the HAT selection medium had successfully killed the unfused P3X63Ag8.653 cells.

Ten days after the preparation of the hybridomas, supernatants from all wells were tested by ELISA for the presence of antibodies reactive with peptide 29 KDa. Based on the results of this preliminary assay, cells from 3 wells were transferred to a 24-well culture dish and expanded. Several days later, supernatants from these cultures were retested by ELISA for the presence of antibodies that bind to peptide 29 KDa.

The absorbance values obtained with the supernatants from hybridoma cultures 02-100EC7, 02-100HH10 and 02-100FG5 are presented in Table 3. Based on these results, cultures 02-100EC7 and HH10 were expanded, cryopreserved and cloned by limiting dilution. Two-three clones of each culture were expanded and cryopreserved for future evaluation.

TABLE 6

Immunoassay of Supernatants from Anti-29 kDa Hybridomas Supernatants from T75 Culture Flasks

| Culture ID | Culture Dilution | Detection With Anti-Mouse IgG-1 | Detection With Anti-Mouse Gamma |
|---|---|---|---|
| 02-100HH10 | 2 | 1.021 | 0.312 |
| 02-100EC7 | 2 | 0.687 | 0.230 |
| 02-100FG5 | 2 | 0.048 | 0.048 |
| Buffer Alone | | 0.044 | 0.050 |

TABLE 7

LOCUS 1 (E8/B1/I16)
GATCCCGTTGTGCTTCACACCCGATAGATAGGGATTTACAGATAAATTCAGGTCTCTTCC

ACGTCATATTTGGACCCATCGAAAATTCGGGTTCTCAAATCATCGAACATAACAAAAGAA

GCTAAGCAACATGTAGGCCGTTGTCACTTAACTTCTTGTTTTTCCGATGACAGCTTCTAT

TTAGAGAATGTCATGATTATTTTATATTCACTTCAATGTTATCAATATTAGTGCCATCTA

TGACATCTGCCATGCGATTTTCTTGTAATTTTTTGTGCAATTCAAACGTGTACTTTCCAC

CGTTTTTCATTTTAATAACAATTTTACCTGAACCAACGTTACCGTACAGATTATTTTTTT

CAATAAGTTGTTTTCTCAATTTAAAATCAAGTTCTTTCAAGGAAATCTGTTCTTTAGTAA

TCTTGAATTCTGAAACATCATGAGAGATTGTACCTTTATTATCTTCCTTAGTAATTCTTA

CTCCTGCTTTGTGATCAACTTTTTTACTATTACTCTTTGTGATACCACCGACAGAATATT

TABLE 7-continued

```
TTTCCAGATTGTAATTATTTTCTTCTAAAACGACAAATACATCGACATTCCTATGTACTC
CTTCACCATATTTTTTATCATCTTTACCAACTAAAGCAATTTTATATATGAAATAATCTG
GGACAACATTCATAAATCTTATTGTCGTCCATTTTTTTAAAATAATACCAATCTCATTTT
TAAATTCTAAACTTGGTTTCGTATAATACGCTCTTAAATCTTTAAATTTAGGATTTATTT
CTGTTGGTACTTGTTTTGTGGTTGGCGATTGTGGTGTGTCTGATTTAGTAGATTGCATTG
GTTGTGGCGTGTTTGTTGATGGAGGTGTTGTCACTTTAGTTGAAGGCGGTGTTGTCGCAT
TTGCTGTTTGTTGCGGTGCTTCTACTTTAGTTGAGGGCGGTGTTGTCGCGTTTGGTTTTG
ATTGCGGTGCTTCTATTTTAGTTGAGGGCGGTGTTGATTGTGGTGCTTCCACTTTAGTGG
AAGATAGTGTTGTCGCGTTTGCTGCTTGCGTTGTCGTTGTGATTACACCTGTTGTTAAAA
GGCCTAGTGCTAAACTTGTTTTAGCAATCGTTGTTATTTTCATAGTTGTATGCTCCATTC
GTAATTATTAGATTTGTTCGATTACATTCATTGAATCATACAGCTTTATTATAGATGGCG
TATTGCTCCATTCACATTAAACCTTGTTTAACTATATTTGAATCATCGTTAAGTAAATTA
AGAAATCCATAATGTTCGTTAAATAAAAATGATTTTGATGTGATTCAACACTTGGCACAT
TTGAAGTTTCGTCACTTTTAAGACATAGAAATGCCACTTTTACAAACAAATGAATATTCG
TCTTTTTACATCATTACGCATAATAAAAGAAGCTAAGCAACATGTAAACCGTTGTCACTT
AACTTCTTGTTTTTCCGATGACAGCTTCTATTTAGAGAATGTCATGATTATTTTATATTC
ACTTCAATGTTATCAATATTAGTGCCATCTATGACGTCTGCCATACGATGCTCTTGCAGT
TTTTTGTGTAATTCAAACGTATATTTCCCACCGTTTTTCATTTTAATAACGATTGTTCCT
GAACCCATGTTACCGTAAAGATTATGTTTTTCAATAAGTTGTTTTCTCAATTTAAAATCA
AGCTCTTTCAAGGAAATCTCTTCCTTAGTAATCATGTATTCTGAAACATCGCGTGAAATC
ATACCTTGATTATCTTTTTAGTAATGCTTAATTCTACTTTGTGATTAACTTTTTTACTA
TTAGTCTTCGTGATGCCACCGACAGAATATTTTTTCAATTGATATTTATTGTCTTCTAAA
ACGATAAATACATCGATATTATCGTAAGGTCCATCTTTATATTTTTTCTCATCTTTTCCA
ACTAAAGCTATTTTATAGATGAACCTATTTGGAATAACATTCATAAACCTAACCGTCGTC
CATGGTTTGAGCATAAATCCAAACTGCTTTTCAAATTCAAAACTCGGTTTTGTATAATAC
GCTCTTAAATCTTCATATTTAGGAGTCATATCTGTTTGTGCTTGTTTTATGGTTGGAGAT
TGTGGTGTGTCTGATTTAGTAGATTGCATTGGTTGTGGCGTGTTTGTTGATGGAGGTGTT
GTCACTTTAGTTTTCGGCGTTGTGGATTCGGTTGTCGTTTGTCATTGTTCTTGTTTAGGC
GCTGGCGTTGCTGATATATTAAGCGTTTTCTGCTCTTCTTGTTTAGGTTGTGATATTTTT
TCTATTTTGGAAGCTGAGGTTTTTTCCTCATTAGTATTTGGTGCCTTTTCGAGTTTAGGC
GTGCGTTCTTGTCTTGTGTTAGCTGCTTGTGTTGTCGCTGAATTTGCACCTGCTGTTATG
TTTATCATTGCTAATCGCTCTGCTTTAAGCGTTGGTACTTTGTCAACTTTAGTTGATTGT
ATTTTTTCTGCTTTGACCGATTGCGTCGTTACTGTAATTGCGCCTGTTGTTAAAAGCCCT
AGTGCTAAACTGGTTTTAGCAATTGTTCTCATTTTCATAATTGTATGCTCCAATCTATAT
TATATTCGATTGTCTTTTTACGTAATTTGAATCATACAACATCATTATAGATGGCGTTCT
AAGATAATCACATTAAACCCCTTTTAACAATTATTGAAGTATTATTAAGTAATTTAAGCA
AAAATAATGAGTGAGTATGAGATTAATATAGCGTTTCTATCTGCCTTTGAAATAATTTT
TAAGCATTAAAAAGAAGTTAAGCAACGTTTGATCGTCACTTAACCTCTCTATTTCAATTT
CAACTTATTTCGTCATCAAGTATATGTGTTATGCTTTTATAACTTTGATTTCAATTCTAT
CAATATCTGTGACATTGATAACATCGGACATACGGTCTTCTTGTAACTTTTTATCCAATT
```

TABLE 7-continued

```
CAAATGTATACTTTCCATAGTATTTCTTTTTGACTGTAATTTTTCCTGTACTCATTTCAC
CGTAAAGACCATAATTATCAATAAGGTATTTTCTTAATTTAAAATCAATCTCTTTCAATG
ACATCGCTTCTTTATCTATTTTAAATGGGAAAAAGTCATAATCATATTCACCAGTATGAT
CTTCTTTAATAACTCTTGCTTCTGCTATTAGGTCGACAGCTTTATCGTTTGCACTCGTGA
TACCCCCAATAGAGTACTTTGCACCTTCAAATCTCTTATCCTCATTAACGTAAAATATAT
TAAGATTACGATGTACACCCGTATGATAATGTTGCTTATCTTTGCCAATTAAAGCAATAT
TATTAACAGAATTACCATCTATGATATTCATAAATTTAATACTTGGTTGAATGAAACTGA
TATAACCTGTCACATTTITATATTCAATACTAGGTTGATTATAATAAGCTTTTAATTTTT
TGCTATTTTCACTTATTACAATAGGTTTCTTTTCGGCATGAACTGGTTTTTCCGTTGTAG
TGTTTACACCTGTTGCTAATATTCCTAATAACAAACTTATTTTTGCAATATTTTTCATTT
TCATAGTTGTATGCTCCAATCTATTATAATTAGATTGTTTTATTACGTAATTTGAATCAT
ACACCCATATTATAGGAGCTGTATTCGGATATTCACATTAACCTGTTTTTAACTATTCAT
AAAATATGATTAAGCTATTTAAGCAAAAGATC

LOCUS 2 (B10/I15)
GATCAAACTACTAATAAAAACGTTTTAGATAGTAATAAAGTTAAAGCAACTACTGAACAA
GCAAAAGCTGAGGTAAAAAATCCAACGCAAAACATTTCTGGCACTCAAGTATATCAAGAC
CCTGCTATTGTCCAACCAAAAACAGCAAATAACAAAACAGGCAATGCTCAAGTAAGTCAA
AAAGTTGATACTGCACAAGTAAATGGTGACACTCGTGCTAATCAATCAGCGACTACAAAT
AATACGCAGCCTGTTGCAAAGTCAACAAGCACTACAGCACCTAAAACTAACACTAATGTT
ACAAATGCTGGTTATAGTTTAGTTGATGATGAAGATGATAATTCAGAAAATCAAATTAAT
CCAGAATTAATTAAATCAGCTGCTAAACCTGCAGCTCTTGAAACGCAATATAAAACCGCA
GGCGTAGCTCGTCCTGAAGGTATCGTAGTTCATGATACAGCTAATGATCGTTCGACGATA
ACTACTTTTAGCGCTTCAGCACAACCAAGATCAGTTGCTGCAACACCAAAAACGAGTTTG
CCAAAATATAAACCACAAGTAAACTCTTCAATTAACGATTACATTTGTAAAAATAACTTA
AAAGCACCTAAAATTGAAGAAGATTATACATCTTACTTCCCTAAATACGCATACCGTAAC
GGCGTAGGTCGTCCTGAAGGTATCGTAGTTCATGATACAGCTAATGATCGTTCGACGATA
AATGGTGAAATTAGTTATATGAAAAATAACTATCAAAACGCATTCGTACATGCATTTGTT
GATGGGGATCGTATAATCGAAACAGCACCAACGGATTACTTATCTTGGGGTGTCGGTGCA
GTCGGTAACCCTAGATTCATCAATGTTGAAATCGTACACACACACGACTATGCTTCATTT
GCACGTTCAATGAATAACTATGCTGACTATGCAGCTACACAATTACAATATTATGGTTTA
AAACCAGACAGTGCTGAGTATGATGGAAATGGTACAGTATGGACTCACTACGCTGTAAGT
AAATATTTAGGTGGTACTGACCATGCCGATCCACATGGATATTTAAGAAGTCATAATTAT
AGTTATGATCAATTATATGACTTAATTAATGAAAAATATTTAATAAAAATGGGTAAAGTG
GCGCCATGGGGTACGCAATCTACAACTACCCCTACTACACCATCAAAACCAACAACACCG
TCGAAACCATCAACTGGTAAATTAACAGTTGCTGCAAACAATGGTGTCGCACAAATCAAA
CCAACAAATAGTGGTTTATATACTACTGTATACGACAAAACTGGTAAAGCAACTAATGAA
GTTCAAAAAACATTTGCTGTATCTAAAACAGCTACATTAGGTAATCAAAAATTCTATCTT
GTTCAAGATTACAATTCTGGTAATAAATTTGGTTGGGTTAAAGAAGGCGATGTGGTTTAC
AACACAGCTAAATCACCTGTAAATGTAAATCAATCATATTCAATCAAACCTGGTACGAAA
CTTTATACAGTACCTTGGGGTACATCTAAACAAGTTGCTGGTAGTGTGTCTGGCTCTGGA
```

TABLE 7-continued

```
AACCAAACATTTAAGGCTTCAAAGCAACAACAAATTGATAAATCAATTTATTTATATGGC
TCTGTGAATGGTAAATCTGGTTGGGTAAGTAAAGCATATTTAGTTGATACTGCTAAACCT
ACGCCTACACCAACACCTAAGCCATCAACACCTACAACAAATAATAAATTAACAGTTTCA
TCATTAAACGGTGTTGCTCAAATTAATGCTAAAAACAATGGCTTATTCACTACAGTTTAT
GACAAAACTGGTAAGCCAACGAAAGAAGTTCAAAAAACATTTGCTGTAACAAAAGAAGCA
AGTTTAGGTGGAAACAAATTCTACTTAGTTAAAGATTACAATAGTCCAACTTTAATTGGT
TGGGTTAAACAAGGTGACGTTATTTATAACAATGCAAAATCACCTGTAAATGTAATGCAA
ACATATACAGTAAAACCAGGCACTAAATTATATTCAGTACCTTGGGGCACTTATAAACAA
GAAGCTGGTGCAGTTTCTGGTACAGGTAACCAAACTTTTAAAGCGACTAAGCAACAACAA
ATTGATAAATCTATCTATTTATTTGGAACTGTAAATGGTAAATCTGGTTGGGTAAGTAAA
GCATATTTAGCTGTACCTGCTGCACCTAAAAAAGCAGTAGCACAACCAAAAACAGCTGTA
AAAGCTTATACTGTTACTAAACCACAAACGACTCAAACAGTTAGCAAGATTGCTCAAGTT
AAACCAAACAACACTGGTATTCGTGCTTCTGTTTATGAAAAAACAGCGCAAAAACGTGCG
AAATATGCAGACCGTTACGTTCTATGTAACAAAGAGCGTGCTCATGGTAATGAAACGTAT
GTATTATTAAACAATACAAGCCATAACATCCCATTAGGTTGGTTCAATGTAAAAGACTTA
AATGTTCAAAACTTAGGCAAAGAAGTTAAAACGACTCAAAAATATACTGTTAATAAATCA
AATAACGGCTTATCAATGGTTCCTTGGGGTACTAAAAACCAAGTCATTTTAACAGGCAAT
AACATTGCTCAAGGTACATTTAATGCAACGAAACAAGTATCTGTAGGCAAAGATGTTTAT
TTATACGGTACTATTAATAACCGCACTGGTTGGGTAAATGCAAAAGATTTAACTGCACCA
ACTGCTGTGAAACCAACTACATCAGCTGCCAAAGATTATAACTACACTTATGTAATTAAA
AATGGTAATGGTTATTACTATGTAACACCAAATTCTGATACAGCTAAATACTCATTAAAA
GCATTTAATGAACAACCATTCGCAGTTGTTAAAGAACAAGTCATTAATGGACAAACTTGG
TACTATGGTAAATTATCTAACGGTAAATTAGCATGGATTAAATCAACTGATTTAGCTAAA
GAATTAATTAAGTATAATCAAACAGGTATGACATTAAACCAAGTTGCTCAAATACAAGCT
GGTTTACAATATAAACCACAAGTACAACGTGTACCAGGTAAGTGGACAGATGCTAAATTT
AATGATGTTAAGCATGCAATGGATACGAAGCGTTTAGCTCAAGATCCAGCATTAAAATAT
CAATTCTTACGCTTAGACCAACCACAAAATATTTCTATTGATAAAATTAATCAATTCTTA
AAAGGTAAAGGTGTATTAGAAAACCAAGGTGCTGCATTTAACAAAGCTGCTCAAATGTAT
GGCATTAATGAAGTTTATCTTATCTCACATGCCCTATTAGAAACAGGTAACGGTACTTCT
CAATTAGCGAAAGGTGCAGATGTAGTGAACAACAAAGTTGTAACTAACTCAAACACGAAA
TACCATAACGTATTTGGTATTGCTGCATATCATAACGATCCTTTACGTGAAGGTATTAAA
TATGCTAAACAAGCTGGTTGGGACACAGTATCAAAAGCAATCGTTGGTGGTGCTAAATTC
ATCGGCAACTCATATGTAAAAGCTGGTCAAAATACACTTTACAAAATGAGATGGAATCCT
GCACATCCAGGAACACACCAATATGCTACAGATGTAGATTGGGCTAACATCAATGCTAAA
ATCATCAAAGGCTACTATGATAAAATTGGCGAAGTCGGCAAATACTTCGACATCCCACAA
TATAAATAAGCAACATGAACATAGGATCAAAAGTC
```

LOCUS 3
```
GATCGCAAGCCAGTTACAGTTGCAGATTTAAAAGTGGAAGGTGCACTTGCAATGATTTTA
AAAGATGCAATAAAACCAAACTTAGTACAATCAATTGAAGGGACACCTGCATTAGTTCAT
GGTGGACCATTTGCGAATATCGCACACGGTTGTAACTCAATTTTAGCAACTGAAACAGCA
```

TABLE 7-continued

```
CGTGATTTAGCTGATATCGTTGTAACGGAAGCTGGATTTGGTTCAGACTTAGGCGCTGAA
AAATTCATGGACATTAAAGCGCGTGAAGCAGGATTTGATCCGGCAGCTGTCGTTGTTGTT
GCGACAATTCGTGCGTTAAAAATGCATGGTGGTGTAGCGAAAGATAATTTAAAAGAAGAA
AATGTAGAAGCAGTAAAAGCAGGAATTGTTAATTTAGAGCGTCATGTTAATAATATTAAA
AAATTCGGTGTAGAACCGGTTGTTGCAATTAATGCATTTATACATGATACCGATGCAGAA
GTAGAATATGTAAAATCTTGGGCTAAAGAAAATAACGTACGAATTGCCTTAACTGAAGTT
TGGGAAAAAGGTGGTAAAGGTGGCGTTGACTTAGCAAATGAAGTATTAGAAGTCATTGAT
CAACCTAATTCATTTAAACCTTTATATGAATTAGAATTACCATTAGAGCAAAAGATTGAA
AAGATTGTGACTGAAATCTATGGCGGTTCAAAAGTAACGTTTAGCAGTAAAGCGCAAAAA
CAATTAAAACAATTTAAAGAAAATGGTTGGGATAATTACCCAGTATGTATGGCGAAAACA
CAATATTCATTCTCAGATGATCAAACGTTGTTAGGTGCACCATCAGGATTTGAAATTACA
ATTCGTGAATTAGAAGCGAAAACAGGTGCAGGATTTATCGTAGCGTTGACAGGTGCAATC
ATGACTATGCCTGGTTTACCTAAAAAACCAGCAGCATTAAACATGGATGTTACTGATGAT
GGTCATGCAATTGGGTTATTCTAATAAATCATGTCAATTGTTTAATAAAGATAAGTAAAT
AGTTTAATAGACCGGACTGTTGGAGATGCATTATTTCAGCAGTTCGGTTTTTTGCTGTGC
TAAAAATAGATTCAATTTGGCGAATCTAACGACAATGTTTGAAGGTGGTTAATTAATGTA
TATGAAGATAAAAAGTGGGCTTGAAGAATAGGAAAGCGATGCAATGAATATTCCATATTA
AAAAAAATTAATAAAATAGGTTGCAATATTTAATTGGGATGCGCTACAATTAACACTAAT
AATTGATATTGATAATTATTATCAATTAAATATAATCTTATAGGAGTTGTTAACAACATG
AACAAACATCACCCAAAATTAAGGTCTTTCTATTCTATTAGAAAATCAACTCTAGGCGTT
GCATCGGTCATTGTCAGTACACTATTTTTAATTACTTCTCAACATCAAGCACAAGCAGCA
GAAAATACAAATACTTCAGATAAAATCTCGGAAAATCAAAATAATAATGCAACTACAACT
CAGCCACCTAAGGATACAPATCAAACACAACCTGCTACGCAACCAGCAAACACTGCGAAA
AACTATCCTGCAGCGGATGAATCACTTAAAGATGCAATTAAAGATCCTGCATTAGAAAAT
AAAGAACATGATATAGGTCCAAGAGAACAAGTCAATTTCCAGTTATTAGATAAAAACAAT
GAAACGCAGTACTATCACTTITTCAGCATCAAAGATCCAGCAGATGTGTATTACACTAAA
AAGAAAGCAGAAGTTGAATTAGACATCAATACTGCTTCAACATGGAAGAAGTTTGAAGTC
TATGAAAACAATCAAAAATTGCCAGTGAGACTTGTATCATATAGTCCTGTACCAGAAGAC
CATGCCTATATTCGATTCCCAGTTTCAGATGGCACACAAGAATTGAAAATTGTTTCTTCG
ACTCAAATTGATGATGGAGAAGAAACAAATTATGATTATACTAAATTAGTATTTGCTAAA
CCTATTTATAACGATCCTTCACTTGTAAAATCAGATACAAATGATGCAGTAGTAACGAAT
GATCAATCAAGTTCAGTCGCAAGTAATCAAACAAACACGAATACATCTAATCAAAATATA
TCAACGATCAACAATGCTAATAATCAACCGCAGGCAACGACCAATATGAGTCAACCTGCA
CAACCAAAATCGTCAACGAATGCAGATCAAGCGTCAAGCCAACCAGCTCATGAAACAAAT
TCTAATGGTAATACTAACGATAAAACGAATGAGTCAAGTAATCAGTCGGATGTTAATCAA
CAGTATCCACCAGCAGATGAATCACTACAAGATGCAATTAAAAACCCGGCTATCATCGAT
AAAGAACATACAGCTGATAATTGGCGACCAATTGATTTTCAAATGAAAAATGATAAAGGT
GAAAGACAGTTCTATCATTATGCTAGTACTGTTGAACCAGCAACTGTCATTTTTACAAAA
ACAGCACCAATAATTGAATTAGGTTTAAAGACAGCTTCAACATGGAAGAAATTTGAAGTT
TATGAAGGTGACAAAAAGTTACCAGTCGAATTAGTATCATATGATTCTGATAAAGATTAT
```

TABLE 7-continued

```
GCCTATATTCGTTTCCCAGTATCTAATGGTACGAGAGAAGTTAAAATTGTGTCATCTATT
GAATATGGTGAGAACATCCATGAAGACTATGATTATACGCTAATGGTCTTTGCACAGCCT
ATTACTAATAACCCAGACGACTATGTGGATGAAGAAACATACAATTTACAAAAATTATTA
GCTCCGTATCACAAAGCTAAAACGTTAGAAAGACAAGTTTATGAATTAGAAAAATTACAA
GAGAAATTGCCAGAAAAATATAAGGCGGAATATAAAAAGAAATTAGATCAAACTAGAGTA
GAGTTAGCTGATCAAGTTAAATCAGCAGTGACGGAATTTGAAAATGTTACACCTACAAAT
GATCAATTAACAGATTTACAAGAAGCGCATTTTGTTGTTTTTGAAAGTGAAGAAAATAGT
GAGTCAGTTATGGACGGCTTTGTTGAACATCCATTCTATACAGCAACTTTAAATGGTCAA
AAATATGTAGTGATGAAAACAAAGGATGACAGTTACTGGAAAGATTTAATTGTAGAAGGT
AAACGTGTCACTACTGTTTCTAAAGATCCTAAAAATAATTCTAGAACGCTGATTTTCCCA
TATATACCTGACAAAGCAGTTTACAATGCGATTGTTAAAGTCGTTGTGGCAAACATTGGT
TATGAACGTCAATATCATGTCAGAATTATAAATCAGGATATCAATACAAAAGATGATGAT
ACATCACAAAATAACACGAGTGAACCGCTAAATGTACAAACAGGACAAGAAGGTAAGGTT
GCTGATACAGATGTAGCTGAAAATAGCAGCACTGCAACAAATCCTAAAGATGCGTCTGAT
AAAGCAGATGTGATAGAACCAGAGTCTGACGTGGTTAAAGATGCTGATAATAATATTGAT
AAAGATGTGCAACATGATGTTGATCATTTATCCGATATGTCGGATAATAATCACTTCGAT
AAATATGATTTAAAAGAAATGGATACTCAAATTGCCAAAGATACTGATAGAAATGTGGAT
AAAGATGCCGATAATAGCGTTGGTATGTCATCTAATGTCGATACTGATAAAGACTCTAAT
AAAAATAAAGACAAAGTCATACAGCTGAATCATATTGCCGATAAAAATAATCATACTGGA
AAAGCAGCAAAGCTTGACGTAGTGAAACAAAATTATAATAATACAGACAAAGTTACTGAC
AAAAAAACAACTGAACATCTGCCGAGTGATATTCATAAAACTGTAGATAAAACAGTGAAA
ACAAAAGAAAAAGCCGGCACACCATCGAAAGAAAACAAACTTAGTCAATCTAAAATGCTA
CCAAAAACTGGAGAAACAACTTCAACCCAATCATGGTGGGGCTTATATGCGTTATTAGGT
ATGTTAGCTTTATTCATTCCTAAATTCAGAAAAGAATCTAAATAATTAACTAAATATAGC
ATATGTATGATTAACTTTGTAGACAATGTGAAAGCAATTAATTTATAAACTATTGATTGG
TTTAATGGCTTTCCTTTAGAGTAAATAAAAAGAACAGCAGTGAGAAATTTTCTAATTGAA
AATAATCTTACTGCTGTTTTTAATATTTGGATTCATTGTTGTGGTTACTTTAAAAAGTGA
GCATCAATTAACGCTTTTTTCGATTTAACAAATGTGATTTAATATCATATTTTAATGCGT
CGTTGTATTCTTTTTCAGTGATTTGATCTTCGATTAACATACGCTTTAATACATAATGTT
GTCTTTGAATACTATATTTCAAATCTTTATCCGATTTTAACGTTCCATCTTTTTCGTAGG
GTGTATAGCCATATGGGCTTTGCAACAAACCGATAAGGTATGCAGATTGTGCAATTGATA
AATCTTTTGGTGGAATACCAAATAGACTATATGAAGCGGATGCAATTCCGGAAATATTAG
CGCCATTATAATCTCTACCGAAGGGAACTATATTTAAATATGTATATATAATTTCATCTT
TTGAGAGTAGGTGTTCTAATCTAATTGCTAGGCGAAGTTCATTTGCTTTTCTACTATATG
TTTTTTCGTTGGTAAGAACTTGATTTTTAACAAGTTGTTGTGTAATTGTGCTACCACCTG
AACTTTGATCAGTATTAAAAATA
```

LOCUS 4 (E103)
```
CAAAGTTAATGTGCTCCTTTTCCTAAGTATTAAATCTATGTATCAACGTCATTTTAACAC
TAATTAGAACGCCTTCATAGTGTCATTGAGTATGTAATTATTTCTTGGGAAATTTGTTTT
AATTTTAAAAAACAGGCTTACTTCATATAATTTATGAAATAAACCTGTCAATTTTGGATT
```

TABLE 7-continued

```
GATTATGCTTTGTGATTCTTTTTATTTCTGCGTAATAACGCTAAACCTAAAATGCTAAAT
AATCCGCCGAACAACATGCCGTTGTTTGTTGATTCTTCTCCACCTGTTTCAGGTAGTTCA
GATTTCTTAGATTGTGCTTTTTTAGTTGGTACCACTGCTTTAACCTTTTCATTGATTTCA
ATAACAGGTGTTACTACTTTACCTTGTTCCACTGGTTTAGAAGGTTTTTTAGGTTCTTCT
TTAGCAGGTGGTATTGGTTTACCAGGTTCAGTTGGTACCTCTGGCGTTGGCGGTGTTGGT
GTTTCCGGCTCGCTTGGTACTTCTGGTGTCGGTGGTGTTGGTGTTTCCGGCTCGCTTGGT
ACTTCTGGTGTCGGTGGCGTTGGTGGCACGATTGGAGGTGTTGTATCTTCTTCAATCGTT
TGTTGACCTTCATTATGACCACTTACTTGTGGAAGTGTATCTTCTTCAAAGTCAACACTA
TTGTGTCCACCGAATTGATAATTTGGTTTATCTTTATTTGTATCTTCTTCAATAATTTCA
GTGTGCTTATTGAATCCGTGAATATGTGGCACACTGTCGAAGTCGATATCAATGATATTA
CCACCTTGTTCATACTTAGGTTTGTCTITCTCTGTATCTTCTTCGAATGATTGGTTACCA
TTATTTTGACCATGAATTTGAGGTACACTATCGAAATCGATATCTACGATATTGCCACCT
TGTTCATATTTCGGTTTATCTTCTTCTGTGTCTTCCTCAAATGACTGATTACCGCTATTT
TGGCCACCTTCGTAACCTAATTCACTCTTAATATCCACGTGGCTATTTTCTTCGATTTCT
TCAATCACGCCATAATTACCGTGACCATTTTCAGTTCCTAAACCAGAATGAGAAATATGA
TGATTGTTTTCAGTAATTTCCTCGATTGGTCCTTGCGCTTGACCATGTTCTTCAGGTAGT
TCATCTACTAGTTCAATCAGATTACTTTCAGTCGTATATTCTTTCGTATCTTCAATTGTT
GTATGATCGCTAACAGCACCAGTTACAATACCTTTTGTAGAATCTTCGTCAAATTCAACT
AGGTTAGACTCAGTAGTAACCTGACCACCACCTGGGTTTGTATCTTCTTCATATTCAACA
ACATCAGCATGATGTTTTGAATTTTCATGTGTCGATTCTTCAAAGTCTACATGAATAGAA
TCTTCTTCAGTTTCAATGGTACCTTCTGCATGACCTTCTGCACCTTCAACAGCTGTATGA
TATTCAAAATCAATTGGCTTAGAATCATTACTTTCTTCGATTGTACCAGTCAATTCATGC
TTCTCCACTGGCGGCTCTGATTTAAATTCAAGTTCGATAGGAGTACTATGTTCTATAATA
GGTTCCTTTAGTTTATCTTTGCCGTCGCCTTGAGCGTTATTAGAGTAAAATGCAACGCCA
TTTTTCCAAGTTAAATTACTTGTATAATAATAGTTATAATATCCAAAAGGTGTGTTTGA
AATTCTAAGTTGCTAGCATTTGAATCATAATACCCTTCATATTTTATTACATAATTTTTA
CTTTGGTCTAAATTATTAAAGTTTAAAGAATAACCACCATTAGTATCAAAATCTAAACTC
ATATTATCAGTCACATCTTCAAATTTGCTGACATCATCAAGCTTTGCATATACGCTTTCA
GCTAAATCGTCTGAACCAATGTGTTTATATACCTTAACTGTTGGATTAITAACCCCTGGT
TTATTTCCTTTAGTTACTTGACCAGTTACTGTCACAGAGCTTAACGACTGGTTGTTAGGT
TTCATGTACGCAAAATGACTAAATTTCCCATCTACTTTATTTAAAGTATCAATTCGACCA
TTAGCTGTTACTCCCCAATTATCTCTAACTCCACCTAAATATTGAATATTAAATATTTTG
CTAACCGTAGTCTCACCCAATTTAACTTCAACATTTTGGTTACCTTTTTGCGTCACTGTT
GTAGGATCAATAAATAGATTTAAAGATAATTCAGCAGTTAAATCTTTCTTTTCTTGTACA
TATTCTTTAAACGTATATCTAACTTTTCTTTCTCCAATTATTTCTCCTGTCGCCATAACT
TGACCATCTGTACTTTTTATCTCCGGAACTTTACGCAGTGTTGAGATACCATGAGTTTCA
ACATTATCGCTTAATGTGAAATCAAAATAATCTCCCGCCTTAATTCCTTCTCCAAATTTC
CATTTATATTTCAAGGTTACTCTTTCTGCGTTATGAGGATTTACAACATTCGTATCTTGT
TTATGTCCTACAATTTCACTACCTTCTTCTACTTCCACTTTATTTGTTACATCTGTACCT
GTCGCTTTAGTTTCTTCCACTACTTCTTTCTCTGCAACTGCTGTAACGTCAGTTGATCTT
```

TABLE 7-continued

```
TTCATTCTTGGTTTAATTTCTGAGACGTTACTTGGTTGAGCTATGTCAACTTGAGTTCCT
GTAGTTTCCTTATCAGCAACTTTTTCCGATGGCAAATCAACTCGCGAAGTTTCTACTTTT
GGTGCTTGCACAGTTTTCGGTGCTTCTTCTGTTGTTACTTGTGTTGATTGTGATGGTTGC
TCAGTTGATGTCGCGCTGTATGATTGTGTTTCATCTATTGTATTAACGTTATTTGTAGTT
GTTTGTGTTTCGCTTGCTTTACTTTCAGTAGCTGAACTCCCACTTTCCTCTACTGTAGTA
TTGTTTTGTTCCGATGCTGCAGCTTCTTTTTCTTGTCCCATTCCAACAACGATCATTGTT
CCTAAGAATACTGAGGCCGCTCCCAATTTGTGTTTTCTTATGCCGTATCTAAGATTGCTT
TTCACTATAATATTCTCCCTTAAATGCAAAATTCATTTATTTTTAAAACTCAATAAATGC
AATTCTATATTGTTCGGTTTTTAAAAGCAATGAAAAAAAGCGAGTTAATAAAAAGTTAAG
ATTGTTGTTAACTTTATGTATAATGAGTTTTTTATTATTTGAAACTCACATATATATTGC
ATACAAAGCTCTTGAACACCTTGATATAACAGGCTTGTATTTTTATACTTACTTTTTAA
ATTAAATTCAAATTCATCTAATTTAAAACAATATACTAAACCATACATAATAATCGCCTG
TACAATGCATCATTAACAAGTCACTGAAACGCCTTTCATTGTATTAATAACGTCACTATA
ATTTTTATATCGTTCGGTTTTTGTTTGATTTTTAATGATTATTATACAAAAACAGCCGTA
TTTCAAGCCGACATTTTAAATTTAACTAAATTTGCATCTAGTTAATAATTGCATTTATCA
AATTTGTCTTATTGATCCAATCTAATTTGTACTCACAAACTAGTTTAAAATTCTAACTTT
ATCTCTCAGTTCGTTATCAATCATCAGACATAAACCAATGAAGCAATCAGAAAACACTCT
AATTTTCTATTAGAAATTTGATTTAATATAAAAAAACAGGCTTACTTCATATAATTTATG
AAATAAACCCGTCAATTTTTGTTTAATTATGCTTTGTGATTCTTTTTATTTCTGCGTAAT
AATGCTAAACCTAGAATGCTGAATAATCCGCCGAACAACATACCTTTGTTTGTTGATTCT
TCTCCACCTGTTTCAGGTAGTTCAGATTTCTTAGATTGTGGTTTTTTAGTTGGTGCCACT
GCTTTAACCTTTTCATTGATTTCAATAACAGGTGTTACTACTTTACCTTGTTCCACTGGT
TTAGAAGGCTTTTTAGGTTCTTCTTTGGCAGGTGGTACTGGTTTACCAGGTTCAGCTGGT
ACCTCTGGTGTTGGCGGTGTTGGAGTTTCTGGCTCACTCGGCACTTCTGGTGTCGGTGGT
GTTGGTGTTTCCGGCTCACTTGGTACTTCTGGTGTTGGTGGCGTTGGTGTTTCCGGCTCA
CTTGGTACTTCTGGTGTCGGTGGCGTTGGTGGCACGATTGGAGGTGTTGTATCTTCTTCA
ATCGTTTGTTGACCTTCATTTTGGCCGCTTACTTTTGGAAGTGTATCTTCTTCAAAGTCA
ACACTATTGTGTCCACCGAATTGATAACTTGGTTTATCTTTATTTGTATCTTCTTCAATA
ATTTCAGTGTGCTTATTGAATCCGTGAATATGTGGCACACTGTCGAAGTCGATATCAATG
ATGTTACCGCCATGTTCATACTTAGGTTTGTCTTTTTCTGTATCTTCCTCGAATGACTGA
TTACCTTTATTTTGACCATGAATTTGAGGTACACTATCAAAATCGATATCTACGATATTG
CCACCTTGTTCATATTTAGGTTTGTCTTCTTCTGTGTCTTCCTCGAATGACTGGTTACCG
CTATTTTGGCCACCTTCATAACCTAATTCACTCTTAATATCAACGTGGCTATTTTCTTCG
ATTTCTTCAATCACGTCATAATTCCCGTGACCATTTTCAGTTCCTAAACCAGAATGAGAA
ATATGATGATTGTTTTTAGTAATTTCCTCGACTGGTCCTTGTGCTTGACCATGCTCTTCA
GGTAATTCATCCACTAATTCAATCAGATTACTTTCAGTTGTATATTCTTTCGTATCTTCA
ACTGTTGTATGATCGCTCACTGCGCCAGTTACAATACCTTTTGTAGACTCTTCGTCAAAT
TCAACTAAGTTAGACTCAGTAGTAACCTGACCACCACCTGGGTTTGTATCTTCTTCATAT
TCAACAACATCAGCGTGATGTTTTGAATTTTCATGTGTAGATTCTTCAAAGTCAATTGGA
TTTGATTCCTCAGAGGACTCAGTGTATCCTCCAACGTGACCTGCTTCGCTATCCACAGCA
```

TABLE 7-continued

```
GTATGGTAATCGATATCAATAGCTGATGAATCCGTTTCTTCTATTGTTTCAATGTATCCA

TCAACATATCCACCTCCACCATCTATAGCTGTGTGGTAATCAATGTCAAGAGTTGATGAA

TCATATTCCTCTTCAACAGTAGTTACTAAATTCTTATCATATTGACCTGTAAGAGTTTCT

TTAATTGTATCTTCTTTATATTCAAATTTATTATTTTGAATAATCGGACCATTTTTCTCA

TTTCCGTTCGCTTTATTACTGTATAAAACTAAACCATTATCCCAAGTTAAGGTATATCCT

CTATCATAATAATACTTATAAAGTTGCTCTGGATGTCCTACCATTTGTGTTCTAAAATCA

ACTTCATCAGTACCATTTAAATACTCTCCATCATAGTGAACAACATAAGTTTTATCTAGA

TTTTCTATATTCAATGAATAGCTTCCATTATTTTGTAAATTCAAATTCCCACTCATATTA

CTTGTGACTTCTTTAAATTTAGAAGTATCTGTCGTATTTGCATATACACTCTTCGCTATG

TCTTCATTATTACCCAAGTATTCAAATATCCTAACTTTTGGTTGATTTCCATTCTGATTA

CTACCTTTCATTAAAGTTCCAGTAACAGTCACACTTGTCGTTTTACCATTATTAGGTTTA

ATAAATGCAACATGCGAAAATCTATTATTCGCTTTATTAAATGTCTCAAT
```

LOCUS 5 (L4)
```
GATCAACAAAAAGCTTTTTATCAAGTATTACATCTAAAAGGTATCACAGAAGAACAACGT

AACCAATACATCAAAACATTACGCGAACACCCAGAACGTGCACAAGAAGTATTCTCTGAA

TCACTTAAAGACAGCAAGAACCCAGACCGACGTGTTGCACAACAAAACGCTTTTTACAAT

GTTCTTAAAAATGATAACTTAACTGAACAAGAAAAAAATAATTACATTGCACAAATTAAA

GAAAACCCTGATAGAAGCCAACAAGTTTGGGTAGAATCAGTACAATCTTCTAAAGCTAAA

GAACGTCAAAATATTGAAAATGCGGATAAAGCAATTAAAGATTTCCAAGATAACAAAGCA

CCACACGATAAATCAGCAGCATATGAAGCTAACTCAAAATTACCTAAAGATTTACGTGAT

AAAAACAACCGCTTTGTAGAAAAAGTTTCAATTGAAAAAGCAATCGTTCGTCATGATGAG

CGTGTGAAATCAGCAAATGATGCAATCTCAAAATTAAATGAAAAAGATTCAATTGAAAAC

AGACGTTTAGCACAACGTGAAGTTAACAAAGCACCTATGGATGTAAAAGAGCATTTACAG

AAACAATTAGACGCATTAGTTGCTCAAAAAGATGCTGAAAAGAAAGTGGCGCCAAAAGTT

GAGGCTCCTCAAATTCAATCACCACAAATTGAAAAACCTAAAGTAGAATCACCAAAAGTT

GAAGTCCCTCAAATTCAATCACCAAAAGTTGAGGTTCCTCAATCTAAATTATTAGGTTAC

TACCAATCATTAAAAGATTCATTTAACTATGGTTACAAGTATTTAACAGATACTTATAAA

AGCTATAAAGAAAAATATGATACAGCAAAGTACTACTATAATACGTACTATAAATACAAA

GGTGCGATTGATCAAACAGTATTAACAGTACTAGGTAGTGGTTCTAAATCTTACATCCAA

CCATTGAAAGTTGATGATAAAAACGGCTACTTAGCTAAATCATATGCACAAGTAAGAAAC

TATGTAACTGAGTCAATCAATACTGGTAAAGTATTATATACTTTCTACCAAAACCCAACA

TTAGTAAAAACAGCTATTAAAGCTCAAGAAACTGCATCATCAATCAAAAATACATTAAGT

AATTTATTATCATTCTGGAAATAATCAATCAAAAATATCTTCTCTAGTTTTACATCATTT

TTTAAATAATTTTCGTAACAAACCGTGATTAAAAAGAACCGTTGATTCTCAATCGAATCT

ACGGTTCTTTTTTCATTTTCCATCAATTAAATGCTTCTTCGCTATTTGTCAGCCCACTTT

TTTACCTGCAACTTGTTAAATAATCCTTACATCGTTAACGAATAGTTCATCATTTAGTTG

AATCAGCTCAACTTTATTAACTTCATATTTTCACAAACTATTGCGCAATCCATTCCTTTT

CCACTACAAGCACCATAATTAAACAACAATTCAATAAAATAAGACTTGCAAAGCATAGTT

ATGTAGCTATATAAACCCCTGCGACCAATAAATCTTTTAAACATAACATAATGCAAAAC

ATCATTTAACAATGCTAAAAATGTCTCTTCAATACATGTTGATAGTAATTAACTTTTAAC
```

TABLE 7-continued

```
GAACAGTTAATTCGAAAACGCTTACAAATGGATTATTATATATATGAACTTAAAATTAAA

TAGAAAGAAAGTGATTTCTATGATTAAAAATAAAATATTAACAGCAACTTTAGCAGTTGG

TTTAATAGCCCCTTTAGCCAATCCATTTATAGAAATTTCTAAAGCAGAAAATAAGATAGA

AGATATCGGCCAAGGTGCAGAAATCATCAAAAGAACACAAGACATTACTAGCAAACGATT

AGCTATAACTCAAAACATTCAATTTGATTTTGTAAAAGATAAAAAATATAACAAAGATGC

CCTAGTTGTTAAGATGCAAGGCTTCATTAGCTCTAGAACAACATATTCAGACTTAAAAAA

ATATCCATATATTAAAAGAATGATATGGCCATTTCAATATAATATCAGTTTGAAAACGAA

AGACTCTAATGTTGATTTAATTAATTATCTTCCTAAAAATAAAATTGATTCAGCAGATGT

TAGTCAGAAATTAGGCTATAATATCGGCGGAAACTTCCAATCAGCGCCATCAATCGGAGG

CAGTGGCTCATTCAACTACTCTAAAACAATTAGTTATAATCAAAAAAACTATGTTACTGA

AGTAGAAAGTCAGAACTCTAAAGGTGTTAAATGGGGAGTGAAAGCAAATTCATTCGTTAC

ACCGAATGGTCAAGTATCTGCATATGATCAATACTTATTTGCACAAGACCCAACTGGTCC

AGCAGCACGAGACTATTTCGTCCCAGATAATCAACTACCTCCTTTAATTCAAAGTGGCTT

TAATCCATCATTTATTACAACATTGTCACACGAAAGAGGTAAAGGTGATAAAAGCGAGTT

TGAAATCACTTACGGCAGAAACATGGATGCTACATATGCTTACGTGACAAGACATCGTTT

AGCCGTTGATAGAAAACATGATGCTTTTAAAAACCGAAACGTTACAGTTAAATATGAAGT

GAACTGGAAAACACATGAAGTAAAAATTAAAAGCATCACACCTAAGTAAACAGTTCAATC

ATCTTAAAAAATCCTGGGACACTTCATACTTGTCTCAGGATTTTTTAACAAATTGAATCA

GCCTCATAACATTAAATTATTTTATCGTACATTAAATTTAATAATAACAACTGATTTTTA

TAAGAATAAAGTATCGAACCATAGTAGATACACAAATAATACAAATGAAACAATTTAACT

TGAAAGCTTAAATAAATATTATCAAGTTAATAAACAATTAATTTTTAGATGGATTCATCA

AAAATCGTAAAAAAGCACAATTTGTATTTTACAAACATTAATTAAAAAAGAAAGCAAGAC

ATTCGTGCAATCGGTTACCTTAAATTGTTTACAACTGTCAACAATACCAAGGTTTTATTA

ACTATATTTCTCACAAAATTAGCTTTTAGCATTCCAAACAAAAAAGGTTAAATCGAACGG

AATTATGGCATTTTTAACTTAATTGTAAAAAAAGTTGATAATGGTCAATTGTTAATGAAC

AGTTAATTATAATAACGCCCAAAATATATTATTATTTAATTAAGTTAAATAAAATTATAG

AAAGAAAGTGAAACTTATGCTTAAAAATAAAATATTAACTACAACTTTATCTGTGAGCTT

ACTTGCCCCTCTTGCCAATCCGTTATTAGAAAATGCTAAAGCTGCTAACGATACTGAAGA

CATCGGTAAAGGAAGCGATATAGAAATTATCAAAAGGACAGAAGATAAAACAAGTAATAA

ATGGGGCGTGACTCAAAATATTCAATTTGATTTTGTAAAGGATAAAAAATATAACAAAGA

TGCTTTGATATTAAAGATGCAAGGATTCATTAGCTCTAGAACAACATATTACAACTATAA

AAAAACTAATCATGTTAAAGCTATGCGATGGCCATTCGAATATAATATTGGTTTAAAAAC

AAATGATAAATATGTTTCTTTAATTAATTATTTACCTAAAAATAAAATTGAATCTACAAA

CGTGAGTCAGACATTAGGATACAATATCGGTGGTAATTTCCAATCAGCCCCATCACTCGG

TGGTAATGGATCATTTAACTATTCTAAATCGATTAGCTATACAC

LOCUS 6 (D1)
GATCATATAAATAGTGTTTAGATGCTATAGTCGGATGCTTAAGTAATTTAAAGAAAGTAT

CTTTAACATCGATGTGTGTATAATCATTTTTAGAAGTATTATAATCTTTTTCTTCTCCTT

CTAAAATATATACAGGTGCTTCATCAGCTAGTGGTTCAACTGGAATGTCAGCATAAACTT

CGTCATCATATGTTAAAACAAAACGATTTGTATCTGTAACTTCACCTATAACAGCACTAT
```

TABLE 7-continued

```
CCAATTCGTGCTTATCAAATAAATCTAAGAATTTTTGTTCAGTACCTTTTTCAACAACTA

GTAACATACGTTCTTGAGTTTCTGAAAGCATCATTTCATAAGGAGAAATACCTGGCTCAC

GTGTTGGCACTTGTTCTAATCTCAAATGTAACCCACTACCACCTTTTGCCGCCATTTCAG

ACGATGAAGATGTTAAACCAGCAGCACCCATATCTTGAATACCAACTAATTCATCAAATG

TAATTGCTTCAAGTGTTGCTTCCATTAATTTTTTACCTACAAATGGATCACCGATTTGTA

CAGAAGGTCGTTTACTTTCGCTTTCTTCCGTCAATTCTTCAGATGCAAAAGTAGCACCAT

GAATACCATCTCGACCAGTTTTCAAACCAACATAAATGACCGAATTACCTACACCTTTTG

CTGTGCCTTTTTGAATCATGTCGTGATTGATAACACCAACACACATTGCATTAACAAGTG

GATTGCCATCATAACGTTCATCAAATTCGATTTCACCAGCAGTTGTTGGAATACCAATGC

AGTTACCATAACCTCCGATACCCTTTACAACACCTTTAAGTAATCTTTGGTTTTGTTTAT

TATCTAATTCTCCAAATCTAAGACTGTTTAACAAATTAATAGGTCTAGCCCCAATAGAGA

CAATGTCACGAATGATTCCACCAACGCCTGTAGCAGCCCCTTGATATGGTTCAATTGCTG

ATGCATGATTGTGAGACTCTACTTTAAATACTACGGCTTGATTATCACCTATATCGACTA

CCCCTGCACCTTCACCAGGCCCCATAAGCACATGGTCACCTGACGTAGGAAATTGCTTTA

AAAACGGTTTAGAATGTTTATAAGAGCAATGTTCACTCCACATAACAGAAAAGATACCTG

TTTCTGTAAAGTTAGGTTGTCTGCCTAAAATATCGCAAACTTTTTCATATTCTTGATCAC

TTAATCCCATATCTTGATATACTTTTTCAAGTTTAATTTCTTCAACGCTTGGTTCGATAA

ATTTAGACATGTTGTTCCCTCCAACTTTTTACCATCGCTTCAAATAATTTCACACCACTA

TCAGTACCTAACAACGTTTCTAAAGCTCTTTCAGGATGTGGCATCATGCCACATACATTG

CCTTTTTCGTTAACAATTCCTGCAATATCATCATATGAACCGTTCGGATTATTCACATAT

TTCAGAATAATTTGATTGTTAGCTTTTAATTGTTGATATATTTCATCAGTACAATAATAA

TGACCTTCACCGTGAGCTACAGGATATATAACTTTTTCACCTTGTTCATAAAGATTTGTA

AATGCCGTTTGATTATTCACTATTTCTAACTCTTCATTTCTACTAATAAATAAATGTGAA

TCGTTATGCAATAATGCACCAGGTAATAAGCCTATTTCAGTTAAAATTTGAAACCCATTA

CAAACACCTAATACT
```

LOCUS 7 (D3)
```
TTCAATTTCTTCTAATTCCATTCTGTAGCCATTCAATTTGATTTGGAAATCAATACGACC

TTGAATGAACCATTGACCATTTTCAAACTTCGCTTTATCACCAGTGTGATATGTACGAAT

ACCGTCATCGAAATTAAATACTTCAGCTGTTTTTGGTCATTTTTTAAGTATCCTAAACT

TACACTTTGACCTTCGATAACAAGTTCACCTTCATCTGTAGTAGATAATCTTGCGCCTGG

TCTTTCAACGCCAACAGGTAATGTCGGATATTGATCTAAGATTTCTTGTGTAATTTGAAT

ACTTGTAACTGCTACCGTAGCTTCAGTTGGACCATATGTGTTGTAAATCGTCGCACTTGG

GAAACGGTTTACTAACGCTTTTGCTGCTCTGTGAGGTAGAATTTCACCACAGAAGAAGAA

TTCGTTAAGACTACCATATTGTTCTTCATTAAGCGTTGGTAATAATAAACACATTTCCAT

AAATGATGGTGTTGATACCCAAATGTTAATCGGTGTTGCTGTTAGCATTTCATTTAATAA

TTTAGGTTTATTAATCATGTTTTTATCTACAAGATTTAATGTACCGCCTGATGCTAAACA

TGGATAAATAGCCATTACAGATAAATCAAATGAAAATGGCGCTTGGTTAAGCCATTGTTG

TTCATTTCCTGATTTATTAAGTTCTAACATCCACTCAGTAAATTGAACTAAACTTGCATA

TTCAATTTGAACACCTTTAGGTTCCCCAGTAGAACCAGATGTAAAGATTGTGTATACTGT

GTCGTTATCTTTAATCTGACTATCAAAAATTACTGGGTCTTGAGATGTTTTAATATCTTC
```

TABLE 7-continued

```
TATTGTAAATACTTCGCCTTCTAAACTTTCAAATGATTCATCAGTCGTATTAAATACAAA
CTCTGGTTGAACCTTGTTAATAATCATTTTAATACGGTCTTCAGGAATTGAAGTGTCTAC
AGGTACATATCCACATCCTGCTTTAATGGCACCAATCATCCCAACAATCATATATGGTGA
CATGTGACCGAATAAAATCATCGGTTTCTTACTACCTTGTAATCGATGTGCTAATTTACT
AGACTCATCCATTAACTGTTGATAAGTTAATTCATCAGTTGTGTGTCTAACAGCAATGCT
TTGTGGATTTGCATCCGCAAACGCTTGCAGCTTGTTAATAATATCTGTCATATTAAGTCT
CCCTCATTAGAACTCATTATAAATGAAGTTATTGTGTGTCGCCACTGCCATAAATTAA
ATATAAAGTAATAAATATTGCCAAATACAATAGTGTTAATAAATATGGTTTGAATGCTTC
AACATATTTATTAGGTGGCTGTTTACTTTTAGATTTCATATTGCACCTCTTAAAGTTCTT
AGTAAAAACGCCTTTATAAAGACCGTTCAATATAAAATACGTTTTAAAATTTGTTTTTTA
CAATTCATTATATCGATATTCATAATGAAATTCAATTTTAATTTTATAGATTCAACATAG
TAATTGGTTGTCATCACTCAATTATTGTAAATGATACACTTTGTTGAGAACATCATTCAT
TTTAAAGGTTATTTAAACAATAAACAATTACAGTCTATATAACAATTTTGTTATATACGT
CAAAATCAAATAAACTCATCACATTAATATGACGAGTTTATAATGTTATTGAATTATCAT
CAGCGCAAATATATACATTCGCAAGTCAAGCATAACATATTTAACAATTGCTTTGCTTGT
TTTACCAATGATTAAAAACCATACTTATTTTCAATTTACTGGAGTATGTGGTACCTGATT
TGTCATAACCGCTTCTATATTATTAATACATAATTGAATCATATTGTCCCGTGTTGTTAC
TGATGCGCTACCAATGTGTGGTGTAATCAGAACATTATCACGTCCCATTAATGGATGTGT
ATG

LOCUS 8 (D4)
TGATCCAAATATTCACCAAGCTGTAGTTCAAGATGATAACCCTGATTTTGAATCTGGCGA
AATCACTCAAGAACTACAAAAAGGATACAAGCTTAAAGATAGAGTATTAAGACCATCAAT
GGTCAAAGTAAACCAATAACTTAAATTTGGCGAAAAGACATTGTTTAAAATTAAATTAAT
TTAATGATTAAATGGAGGAATTTTATTATGAGTAAAATTATTGGTATAGACTTAGGTACA
ACAAATTCATGTGTAACAGTATTAGAAGGCGATGAGCCAAAAGTAATTCAAAACCCTGAA
GGTTCACGTACAACACCATCTGTTGTAGCTTTCAAAAATGGAGAAACTCAAGTTGGTGAA
GTAGCAAAACGTCAAGCTATTACAAACCCAAACACTGTTCAATCTATTAAACGTCATATG
GGTACTGATTATAAAGTAGATATTGAAGGTAAATCATACACACCACAAGAAATCTCAGCT
ATGATTTTACAAAACTTAAAAAATACAGCTGAAAGCTATTTAGGTGAGAAAGTTGACAAA
GCTGTAATTACAGTACCTGCATAGTTTAACGATGCTGAACGTCAAGCAACTAAAGATGCT
GGTAAAATTGCTGGTTTAGAAGTTGAGCGTATCATTAATGAACCAACAGCTGCAGCATTA
GCATATGGTTTAGACAAAACTGATAAAGATGAAAAAGTTCTTGTTTTTGACTTAGGTGGC
GGTACATTTGACGTATCTATCCTAGAATTAGGTGACGGTGTATTCGAAGTACTATCAACA
GCCGGTGACAACAAACTTGGCGGTGATGATTTTGACCAAGTAATTATTGACTACCTAGTT
GCAGAATTCAAAAAAGAAAATGGCGTAGACTTATCTCAAGATAAAATGGCATTACAACGT
TTGAAAGATGCTGCTGAAAAAGCTAAAAAAGACTTATCAGGTGTATCACAAACTCAAATC
TCATTACCATTTATCTCAGCTGGTGAAAACGGTCCATTACACTTAGAAGTAAACTTAACT
CGTTCTAAATTTGAAGAATTATCAGATTCATTAATTAGAAGAACAATGGAACCTACACGC
CAAGCAATGAAAGACGCTGGCTTAACAAACTCAGATATCGATGAAGTTATCTTAGTTGGT

GGATC
```

TABLE 7-continued

```
LOCUS 9A (D22)
GATCAGAATACGATTAAGCAAGGTGTTAACTTCACTGATGCCGACGAAGCGAAACGTAAT
GCATATACAAATGCAGTGACGCAAGCTGAACAAATTTTAAATAAAGCACAAGGTCCAAAT
ACTTCAAAAGACGGTGTCGAAACTGCGTTAGAAAATGTACAACGTGCTAAAAACGAATTG
AACGGTAATCAAAATGTTGCGAACGCTAAGACAACTGCGAAAAATGCATTGAATAACCTA
ACATCAATTAATAATGCACAAAAAGAAGCATTGAAATCACAAATTGAAGGTGCGACAACA
GTTGCAGGTGTAAATCAAGTGTCTACAACGGCATCTGAATTAAATACAGCAATGAGCAAC
TTACAAAATGGTATTAATGATGAAGCAGCTACAAAAGCAGCGCTTAATGGTACTCAAAAC
CTTGAAAAAGCTAAACAACACGCAAATACAGCAATTGACGGTTTAAGCCATTTAACAAAT
GCACAAAAAGAGGCATTAAAACAATTGGTACAACAATCGACTACTGTTGCAGAAGCACAA
GGTAATGAGCAAAAAGCAAACAATGTTGATGCAGCAATGGACAAATTACGTCAAAGTATT
GCAGATAATGCGACAACAAAACAAAACCAAAATTATACTGATGCAAGTCAGAATAAAAAG
GATGCGTACAATAATGCTGTCACAACTGCACAAGGTATTATTGATCAAACTACAAGTCCA
ACTTTAGATCCGACTGTTATCAATCAAGCTGCTGGACAAGTAAGCACAACTAAAAATGCA
TTAAATGGTAATGAAAACCTAGAGGCAGCGAAACAACAAGCGTCACAATCATTAGGTTCA
TTAGATAACTTAAATAATGCGCAAAAACAAACAGTTACTGATCAAATTAATGGCGCGCAT
ACTGTTGATGAAGCAAATCAAATTAAGCAAAATGCGCAAAACTTAAATACAGCGATGGGT
AACTTGAAACAAGCGATAGCTGACAAAGATGCTACGAAAGCGACAGTTAACTTCACTGAT
GCAGATCAAGCAAAACAACAAGCATATAACACTGCTGTTACAAATGCTGAAAATATCATT
TCAAAAGCTAATGGCGGCAATGCAACACAAGCTGAAGTTGAACAAGCAATCAAACAAGTT
AATGCTGCAAAACAAGCATTAAATGGTAATGCCAACGTTCAACATGCAAAAGACGAAGCA
ACAGCATTAATTAATAGCTCTAATGACCTTAACCAAGCACAAAAAGACGCATTAAAACAA
CAAGTTCAAAATGCAACTACTGTAGCTGGTGTAAACAATGTTAAACAAACAGCACAAGAG
TTAAACAATGCTATGACACAATTAAAACAAGGCATTGCAGATAAAGAACAAACAAAAGCT
GATGGTAACTTTGTCAATGCAGATCCTGATAAGCAAAATGCATATAATCAAGCAGTAGCG
AAAGCTGAAGCATTAATTAGTGCTACGCCTGATGTTGTCGTTACACCTAGCGAAATTACT
GCAGCGTTAAATAAAGTTACGCAAGCTAAAAATGATTTAAATGGTAATACAAACTTAGCA
ACGGCGAAACAAAATGTTCAACATGCTATTGATCAATTGCCAAACTTAAACCAAGCGCAA
CGTGATGAATACAGCAAACAAATCACGCAAGCAACACTTGTACCAAACGTCAATGCTATT
CAACAAGCGGCGACAACGCTTAATGACGCGATGACACAATTGAAACAAGGTATTGCGAAT
AAAGCACAAATTAAAGGTAGCGAGAACTATCACGATGCTGATACTGACAAGCAAACAGCA
TATGATAATGCAGTAACAAAAGCAGAAGAATTGTTAAAACAAACAACAAATCCAACAATG
GATCCAAATACAATTCAACAAGCATTAACTAAAGTGAATGACACAAATCAAGCACTTAAC
GGTAATCAAAAATTAGCTGATGCCAAACAAGATGCTAAGACAACACTTGGTACACTAGAT
CATTTAAATGATGCTCAAAAACAAGCGCTAACAACTCAAGTTGAACAAGCACCAGATATT
GCAACAGTTAATAATGTTAAGCAAAATGCTCAAAATCTGAATAATGCTATGACTAACTTA
AACAATGCATTACAAGATAAAACTGAGACATTAAATAGCATTAACTTTACTGATGCAGAT
CAAGCTAAGAAAGATGCTTATACTAATGCGGTTTCACATGCAGAAGGTATTTTATCTAAA
GCAAATGGCAGCAATGCAAGTCAAACTGAAGTGGAACAAGCGATGCAACGTGTGAACGAA
GCGAAACAAGCATTGAATGGTAATGACAATGTACAACGTGCAAAAGATGCAGCGAAACAA
```

TABLE 7-continued

```
GTGATTACAAATGCAAATGATTTAAATCAAGCAATGACACAATTGAAACAAGGTATTGCA
GATAAAGACCAAACTAAAGCAAATGGTAACTTTGTCAATGCTGATACTGATAAGCAAAAT
GCTTACAACAATGCGGTAGCACATGCTGAACAAATAATTAGTGGTACACCAAATGCAAAC
GTGGATCCACAACAAGTGGCTCAAGCGTTACAACAAGTGAATCAAGCTAAGGGTGATTTA
AACGGTAACCATAACTTACAAGTTGCTAAAGACAATGCAAATACAGCCATTGATCAGTTA
CCAAACTTAAATCAACCACAAAAAACAGCATTAAAAGACCAAGTGTCGCATGCAGAACTT
GTTACAGGTGTTAATGCTATTAAGCAAAATGCTGATGCGTTAAATAATGCAATGGGTACA
TTGAAACAACAAATTCAAGCGAACAGTCAAGTACCACAGTCAGTTGACTTTACACAAGCG
GATCAAGACAAACAACAAGCATATAACAATGCGGCTAACCAAGCGCAACAAATCGCAAAT
GGCATACCAACACCTGTATTGACGCCTGATACAGTAACACAAGCAGTGACAACTATGAAT
CAAGCGAAAGATGCATTAAACGGTGATGAAAAATTAGCACAAGCGAAACAAGAAGCTTTA
GCAAATCTTGATACGTTACGCGATTTAAATCAACCACAACGTGATGCATTACGTAACCAA
ATCAATCAAGCACAAGCGTTAGCTACAGTTGAACAAACTAAACAAAATGCACAAAATGTG
AATACAGCAATGAGTAACTTGAAACAAGGTATTGCAAACAAAGATACTGTCAAAGCAAGT
GAGAACTATCATGATGCTGATGCCGATAAGCAAACAGCATATACAAATGCAGTGTCTCAA
GCGGAAGGTATTATCAATCAAACGACAAATCCAACGCTTAACCCAGATGAAATAACCAGT
GCATTAACTCAAGTGACTGATGCTAAAAATGGCTTAAACGGTGAAGCTAAATTGGCAACT
GAAAAGCAAATGCTAAAGATGCCGTAAGTGGGATGACGCATTTAAACGATGCTCAAAAA
CAAGCATTAAAAGGTCAAATCGATCAATCGCCTGAAATTGCTACAGTGAACCAAGTTAAA
CAAACAGCAACGAGCCTAGATCAAGCAATGGATCAATTATCACAAGCTATTAATGATAAA
GCTCAAACATTAGCGGACGGTAATTACTTAAATGCAGATCCTGACAAACAAATGCGTAT
AAACAGGCAGTAGCAAAAGCTGAAGCATTATTGAATAAACAAAGTGGTACTAATGAAGTA
CAAGCACAAGTTGAAAGCATCACTAATGAAGTGAACGCAGCGAAACAAGCATTAAATGGT
AATGACAATTTGGCAAATGCAAAACAACAAGCAAAACAACAATTGGCGAACTTAACACAC
TTAAATGATGCACAAAAACAATCATTGAAAGTCAAAATTACACAAGCGCCACTTGTTACA
GATGTCACTACGATTAATCAAAAAGCACAAACGTTAGATC
LOCUS 9B (I2)
GATCTTTTAGTTTATTTATAGTTCTTGAAAAGCGTGCTACAAATCCTTTAATCGATTTTA
AATTATTTAAAATAAAGCTTACACAGGTGCAACAGCTTCAAAACTTTTTGTTAAATGGTG
TTGCAGGAACATTAATAGTAGCCAACACATTTGTTCAAAGAGGTTTAGGATATTCTTCAT
TGCAAGCAGGAAGTTTATCAATCACTTATTTAGTAATGGTACTAATTATGATTCGTGTTG
GTGAAAAGTTACTTCAAACACTCGGATGCAAGAAACCAATGTTAATTGGAACAGGAGTTC
TTATTGTCGGAGAATGTCTCATTTCATTAACTTTCTTGCCAGAAATATTCTATGTCATTT
GTTGTATTATAGGTTATTTATTCTTTGGTTTAGGACTAGGGATATATGCTACACCATCAA
CAGATACAGCAATTGCAAATGCACCGTTAGAAAAAGTAGGCGTTGCTGCAGGTATCTATA
AAATGGCTTCTGCATTAGGTGGAGCATTTGGCGTCGCATTGAGTGGTGCAGTATATGCAA
TCGTATCAAATATGACAAACATTTATACAGGTGCAATGATTGCATTATGGTTAAATGCAG
GTATGGGAATATTATCATTCGTTATCATTTTGTTACTTGTGCCTAAACAAAACGACACTC
AATTATGATAATTGAGAATTAAATTGAAATCATACAAGTCGCTACAATATTAAACAAAAA
TATAAACCGATTCTTATGTGTCATTATTTTAAATGAACATAGGGATTGGTTTTTTATTAC
```

TABLE 7-continued

```
TCTTTTACGCTACTTTATTTATAATTATTATAAATTGTCACAAATTCAATTTACCTTACA
ATATATTTTGTGTTATTATATTCTGGAGCATAAATAAATTGTTCAACACATAGTTGTAAT
GTGTTTCAATACTTTTTGGATAGATTGCGAAATTGTATTGAATCGTCATCGTTTTAAATT
TTTAAATGAGAATGGAATGAGCATTACAATACACAAGCAATCAAAAGTAAATACATTCAC
AACACAACAGAGACATAACAACAAGATAAGGAGTGAACAATAGCTGTGAATTATCGTGAT
AAAATTCAAAAGTTTAGTATTCGTAAATATACAGTTGGTACATTTTCAACTGTCATTGCG
ACATTGGTATTTTTAGGATTCAATACATCACAAGCACATGCTGCTGAAACAAATCAACCA
GCAAGCGTGGTTAAACAGAAACAACAAAGTAATAATGAACAGACTGAGAATCGAGAATCT
CAAGTACAAAATTCTCAAAATTCACAAAATGGTCAATCATTATCTGCTACTCATGAAAAT
GAGCAACCAAATATTAGTCAAGCTAATTTAGTAGATCA)AAAGTAGCGCPATCATCTACT
ACTAATGATGAACAACCAGCATCTCAAAATGTAAATACAAAGAAAGATTCGGCAACGGCT
GCGACAACACAACCAGATAAAGAACAAAGTAAGCATAAACAAAACGAAAGTCAATCTGCT
AATAAAAATGGAAACGACAATAGAGCGGCTCATGTAGAAAATCATGAAGCAAATGTAGTA
ACAGCTTCAGATTCATCTGATAATGGTAACGTACAACATGACCGAAATGAATTACAAGCG
TTTTTTGATGCAAATTATCATGATTATCGCTTTATTGACCGTGAAAATGCAGATTCTGGC
ACATTTAACTATGTAAAAGGCATTTTTGATAAGATTAATACGTTATTAGGCAGTAATGAT
C

LOCUS 9C (J13)
GATCAAGAAAAACGTCAAGCGTATGATTCAAAAGTGACTAACGCTGAAAATATCATTAGT
GGTACACCGAATGCGACATTAACAGTCAATGACGTAAATAGTGCGGCATCACAAGTCAAT
GCGGCTAAAACAGCATTAAATGGTGATAACAACTTACGTGTAGCGAAAGAGCATGCCAAC
AATACAATTGACGGCTTAGCACAATTGAATAATGCACAAAAAGCAAAATTAAAAGAACAA
GTTCAAAGTGCAACTACATTAGATGGTGTTCAAACTGTTAAAAATAGTTCTCAAACGTTG
AATACAGCGATGAAAGGCTTAAGAGATAGTATTGCGAATGAAGCAACAATTAAAGCAGGT
CAAAACTACACTGACGCAAGTCCAAATAATCGTAACGAGTACGACAGTGCAGTTACTGCA
GCAAAAGCAATCATTAATCAAACATCGAACCCAACGATGGAACCAAATACTATTACGCAA
GTAACATCACAAGTGACAACTAAAGAACAGGCATTAAATGGTGCGCGAAACTTAGCTCAA
GCTAAGACAACTGCGAAAAACAACTTGAATAACTTAACATCAATTAACAATGCACAAAAA
GATGCGTTAACGCGTAGCATTGATGGTGCAACAACAGTAGCTGGTGTAAATCAAGAAACT
GCAAAAGCAACAGAATTAAATAACGCAATGCATAGTTTACAAAATGGTATCAATGATGAG
ACACAAACAAAACAAACTCAGAAATACCTAGATGCAGAGCCAAGTAAGAAATCAGCTTAT
GATCAAGCAGTAAATGCAGCGAAAGCAATTTTAACAAAAGCTAGTGGTCAAAATGTAGAC
AAAGCAGCGTTGAACAAGCATTGCAAAATGTGAACAGTACGAAGACGGCGTTGAACGGT
GATGCGAAATTAAATGAAGCTAAAGCAGCTGCGAAACAAACGTTAGGTACATTAACACAC
ATTAATAATGCACAACGTACAGCGTTAGACAATGAAATTACACAAGCAACAAATGTTGAA
GGTGTTAATACAGTTAAAGCCAAAGCGCAACAATTAGATGGTGCTATGGGTCAATTAGAA
ACATCAATTCGTGATAAAGACACGACGTTACAAAGTCAAAATTATCAAGATGCTGATGAT
GCTAAACGAACTGCTTATTCTCAAGCAGTAAATGCAGCAGCAACTATTTTAAATAAAACA
GCTGGCGGTAATACACCTAAAGCAGATGTTGAAAGAGCAATGCAAGCTGTTACACAAGCA
AATACTGCATTAAACGGTATTCAAAACTTAGATCGTGCGAAACAGGCTGCTAACACAGCG
```

TABLE 7-continued

```
ATTACAAATGCTTCGGACTTAAATACAAAACAAAAGAAGCATTAAAAGCACAAGTAACA

AGTGCAGGACGTGTATCTGCAGCAAATGGTGTTGAACATACTGCGACTGAATTAAATACT

GCGATGACAGCTTTAAAGCGTGCCATTGCTGATAAAGCTGAGACAAAAGCTAGTGGTAAC

TATGTCAATGCTGATGCGAATAAACGTCAAGCATATGATGAAAAAGTTACAGCTGCCGAA

AATATCGTTAGTGGTACACCAACACCAACGTTAACACCAGCAGATGTTACAAATGCAGCA

ACGCAAGTAACGAATGCTAAGACGCAGTTAAACGGTAATCATAATTTAGAAGTAGCGAAA

CAAAATGCTAACACTGCAATTGATGGTTTAACTTCTTTAAATGGTCCGCAAAAAGCAAAA

CTTAAAGAACAAGTGGGTCAAGCGACGACGTTGCCAAATGTTCAAACTGTTCGTGATAAT

GCACAAACATTAAACACTGCAATGAAAGGTCTACGAGATAGCATTGCGAATGAAGCAACG

ATTAAAGCAGGTCAAAACTACACAGATGCAAGTCAAAACAAACAAACTGACTACAACAGT

GCAGTCACTGCAGCAAAAGCAATCATTGGTCAAACAACTAGTCCATCAATGAATGCGCAA

GAAATTAATCAAGCGAAAGACCAAGTGACAGCTAAACAACAAGCGTTAAACGGTCAAGAA

AACTTAAGAACTGCGCAAACAAATGCGAAGCAACATTTGAACGGCTTAAGTGACTTAACT

GACGCTCAAAAAGATGCAGTGAAACGTCAAATCGAAGGTGCAACGCATGTTAATGAAGTA

ACACAAGCACAAAATAATGCGGATGCATTAAATACAGCTATGACGAACTTGAAAAATGGT

ATTCAAGATCAGAATACGATTAAGCAAGGTGTTAACTTCACTGATGCCGACGAAG

LOCUS 9D (M11)
TATCACAAGCTATTAATGATAAAGCTCAAACATTAGCGGACGGTAATTACTTAAATGCAG

ATCCTGACAAACAAATGCGTATAAACAGGCAGTAGCAAAAGCTGAAGCATTATTGAATA

AACAAAGTGGTACTAATGAAGTACAAGCACAAGTTGAAAGCATCACTAATGAAGTGAACG

CAGCGAAACAAGCATTAAATGGTAATGACAATTTGGCAAATGCAAAACAACAAGCAAAC

AACAATTGGCGAACTTAACACACTTAAATGATGCACAAAAACAATCATTTGAAAGTCAAA

TTACACAAGCGCCACTTGTTACAGATGTCACTACGATTAATCAAAAAGCACAAACGTTAG

ATCATGCGATGGAATTATTAAGAAATAGTGTTGCGGATAATCAAACGACATTAGCGTCTG

AAGATTATCATGATGCAACTGCGCAAAGACAAAATGACTATAACCAAGCTGTAACAGCTG

CTAATAATATAATTAATCAAACTACATCGCCTACGATGAATCCAGATGATGTTAATGGTG

CAACGACACAAGTGAATAATACGAAAGTTGCATTAGATGGTGATGAAAACCTTGCAGCAG

CTAAACAACAAGCAAACAACAGACTTGATCAATTAGATCATTTGAATAATGCGCAAAAGC

AACAGTTACAATCACAAATTACGCAATCATCTGATATTGCTGCAGTTAATGGTCACAAAC

AAACAGCAGAATCTTTAAATACTGCGATGGGTAACTTAATTAATGCGATTGCAGATCATC

AAGCCGTTGAACAACGTGGTAACTTCATCAATGCTGATACTGATAAACAAACTGCTTATA

ATACAGCGGTAAATGAAGCAGCAGCAATGATTAACAAACAAACTGGTCAAAATGCGAACC

AAACAGAAGTAGAACAAGCTATTACTAAAGTTCAAACAACACTTCAAGCGTTAAATGGAG

ACCATAATTTACAAGTTGCTAAAACAAATGCGACGCAAGCAATTGATGCTTTAACAAGCT

TAAATGATCCTCAAAAAACAGCATTAAAAGACCAAGTTACAGCTGCAACTTTAGTAACTG

CAGTTCATCAAATTGAACAAAATGCGAATACGCTTAACCAAGCAATGCATGGTTTAAGAC

AGAGCATTCAAGATAACGCAGCAACTAAAGCAAATAGCAAATATATCAACGAAGATCAAC

CAGAGCAACAAAACTATGATCAAGCTGTTCAAGCCGCAAATAATATTATCAATGAACAAA

CTGCAACATTAGATAATAATGCGATTAATCAAGCAGCGACAACTGTGAATACAACGAAAG

CAGCATTACATGGTGATGTGAAGTTACAAAATGATAAAGATCATGCTAAGCAAACGGTTA
```

TABLE 7-continued

```
GTCAATTAGCACATCTAAACAATGCACAAAAACATATGGAAGATACGTTAATTGATAGTG

AAACAACTAGAACAGCAGTTAAGCAAGATTTGACTGAAGCACAAGCATTAGATCAACTTA

TGGATGCATTACAACAAAGTATTGCTGACAAAGATGCAACACGTGCGAGCAGTGCATATG

TCAATGCAGAACCGAATAAAAAACAATCCTATGATGAAGCAGTTCAAAATGCTGAGTCTA

TCATTGCAGGATTAAATAATCCAACTATCAATAAAGGTAATGTATCAAGTGCGACTCAAG

CAGTAATATCATCTAAAAATGCATTAGATGGTGTTGAACGATTAGCTCAAGATAAGCAAA

CTGCTGGAAATTCTCTAAATCATTTAGATCAATTAACACCAGCTCAACAACAAGCGCTAG

AAAATCAAATTAATAATGCAACAACTCGTGATAAAGTGGCTGAAATCATTGCACAAGCGC

AAGCATTAAATGAAGCGATGAAAGCATTAAAAGAAAGTATTAAGGATCAACCACAAACTG

AAGCAAGTAGTAAATTTATTAACGAGGATCAAGCGCAAAAAGATGCTTATACGCAAGCAG

TACAACACGCGAAAGATTTGATTAACAAAACAACTGATCCTACATTAGCTAAATCAATCA

TTGATCAAGCGACACAGGCAGTGACAGATGCTAAAAACAATTTACATGGTGATCAAAAAC

TAGCTCAAGATAAGCAACGTGCAACAGAAACGTTAAATAACTTGTCTAACTTGAATACAC

CACAACGTCAAGCACTTGAAAATCAAATTAATAATGCAGCAACTCGTGGCGAAGTAGCAC

AAAAATTAACTGAAGCACAAGCACTTAACCAAGCAATGGAAGCTTTACGTAATAGCATTC

AAGATCAACAGCAAACGGAAGCGGGTAGCAAGTTTATCAATGAAGATAAACCACAAAAAG

ATGCTTACCAAGCAGCAGTTCAAAATGCAAAGATTTAATTAATCAAACTAACAATCCAA

CGCTTGATAAAGCACAAGTTGAACAATTGACACAAGCTGTTAACCAAGCTAAAGATAACC

TACACGGTGATCAAAAACTTGCAGACGATAAACAACATGCGGTTACTGATTTAAATCAAT

TAAATGGTTTGAATAATCCGCAACGTCAAGCACTTGAAAGCCAAATAAACAACGCAGCAA

CTCGTGGCGAAGTAGCACAAAAATTAGCTGAAGCAAAAGCGCTTGATCAAGCAATGCAAG

CATTACGTAATAGTATTCAAGATCAACAACAAACAGAATCTGGTAGCAAGTTTATCAATG

AAGATAAACCGCAAAAAGATGCTTACCAAGCAGCAGTTCAAAATGCAAAGATTTAATTA

ACCAAACAGGTAATCCAACACTCGACAAATCACAAGTAGAACAATTGACACAAGCAGTAA

CAACTGCAAAAGATAATCTACATGGTGATCAAAAACTTGCTCGTGATCAACAACAAGCAG

TAACAACTGTAAATGCATTGCCAAACTTAAATCATGCACAACAACAAGCATTAACTGATG

CTATAAATGCAGCGCCTACAAGAACAGAGGTTGCACAACATGTTCAAACTGCTACTGAAC

TTGATCACGCGATGGAAACATTGAAAAATAAAGTTGATCAAGTGAATACAGATAAGGCTC

AACCAAATTACACTGAAGCGTCAACTGATAAAAAAGAAGCAGTAGATCAAGCGTTACAAG

CTGCAGAAAGCATTACAGATCCAACTAATGGTTCAAATGCGAATAAAGACGCTGTAGACC

AAGTATTAACTAAGCTTCAAGAAAAGAAAATGAGTTAAATGGTAATGAGAGAGTCGCTG

AAGCTAAAACACAAGCGAAACAAACTATTGACCAATTAACACATTTAAATGCTGATCAAA

TTGCAACTGCTAAACAAAACATTGATC
```

LOCUS 9E (M13)
```
GATCGTGTATTAGCCTCACATCCAGATGTTGCGACAATACGTCAAAACGTGACAGCAGCG

AATGCCGCTAAATCAGCACTTGATCAAGCACGTAATGGCTTAACAGTCGATAAAGCGCCT

TTAGAAAATGCGAAAAATCAACTACAACATAGTATTGACACGCAAACAAGTACAACTGGT

ATGACACAAGACTCTATAAATGCATACAATGCGAAGTTAACAGCTGCACGTAATAAGATT

CAACAAATCAATCAAGTATTAGCAGGTTCACCGACTGTAGAACAAATTAATACAAATACG

TCTACAGCAAATCAAGCTAAATCTGATTTAGATCATGCACGTCAAGCTTTAACACCAGAT
```

TABLE 7-continued

```
AAAGCGCCGCTTCAAACTGCGAAAACGCAATTAGAACAAAGCATTAATCAACCAACGGAT
ACAACAGGTATGACGACCGCTTCGTTAAATGCGTACAACCAAAAATTACAAGCAGCGCGT
CAAAAGTTAACTGAAATTAATCAAGTGTTGAATGGCAACCCAACTGTCCAAAATATCAAT
GATAAAGTGACAGAGGCAAACCAAGCTAAGGATCAATTAAATACAGCACGTCAAGGTTTA
ACATTAGATAGACAGCCAGCGTTAACAACATTACATGGTGCATCTAACTTAAACCAAGCA
CAACAAAATAATTTCACGCAACAAATTAATGCTGCTCAAAATCATGCTGCGCTTGAAACA
ATTAAGTCTAACATTACGGCTTTAAATACTGCGATGACGAAATTAAAAGACAGTGTTGCG
GATAATAATACAATTAAATCAGATCAAAATTACACTGACGCAACACCAGCTAATAAACAA
GCGTATGATAATGCAGTTAATGCGGCTAAAGGTGTCATTGGAGAAACGACTAATCCAACG
ATGGATGTTAACACAGTGAACCAAAAAGCAGCATCTGTTAAATCGACGAAAGATGCTTTA
GATGGTCAACAAAACTTACAACGTGCGAAAACAGAAGCAACAAATGCGATTACGCATGCA
AGTGATTTAAACCAAGCACAAAAGAATGCATTAACACAACAAGTGAATAGTGCACAAAAC
GTGCAAGCAGTAAATGATATTAAACAAACGACTCAAAGCTTAAATACTGCTATGACAGGT
TTAAAACGTGGCGTTGCTAATCATAACCAAGTCGTACAAAGTGATAATTATGTCAACGCA
GATACTAATAAGAAAAATGATTACAACAATGCATACAACCATGCGAATGACATTATTAAT
GGTAATGCACAACATCCAGTTATAACACCAAGTGATGTTAACAATGCTTTATCAAATGTC
ACAAGTAAAGAAGATGCATTGAATGGTGAAGCTAAGTTAAATGCTGCGAAACAAGAAGCG
AATACTGCATTAGGTCATTTAAACAATTTAAATAATGCACAACGTCAAAACTTACAATCG
CAAATTAATGGTGCGCATCAAATTGATGCAGTTAATACAATTAAGCAAATGCAACAAAC
TTGAATAGTGCAATGGGTAACTTAAGACAAGCTGTTGCAGATAAAGATCAAGTGAAACGT
ACAGAAGATTATGCGGATGCAGATACAGCTAAACAAAATGCATATAACAGTGCAGTTTCA
AGTGCCGAAACAATCATTAATCAAACAACAAATCCAACGATGTCTGTTGATGATGTTAAT
CGTGCAACTTCAGCTGTTACTTCTAATAAAAATGCATTAAATGGTTATGAAAAATTAGCA
CAATCTAAAACAGATGCTGCAAGAGCAATTGATGCATTACCACATTTAAATAATGCACAA
AAAGCAGATGTTAAATCTAAAATTAATGCTGCATCAAATATTGCTGGCGTAAATACTGTT
AAACAACAAGGTACAGATTTAAATACAGCGATGGGTAACTTGCAAGGTGCAATCAATGAT
GAACAAACGACGCTTAATAGTCAAAACTATCAAGATGCGACACCTAGTAAGAAAACAGCA
TACACAAATGCGGTACAAGCTGCGAAAGATATTTTAAATAAATCAAATGGTCAAAATAAA
ACGAAAGATCAAGTTACTGAAGCGATGAATCAAGTGAATTCTGCTAAAAATAACTTAGAT
GGTACGCGTTTATTAGATC
LOCUS 10 (D9)
GATCGTCGGCTAAAACTTGATGTGTTACATCTAAACCAAACACATTTATAGTAATCCCAC
TTTCAAAAACACGCTTCGCTGCTTCAGCATCTACCCAAATATTGAATTCTGCTGTAGGCG
TCCAATTTCCAAATGTACCACCACCCATCAAAGTAATAGATTCAATATGCTCAGCGATTC
TTGGCTCACGAATCAATGCCGTTGCTACATTCGTAAGAGGACCTGTCGCTACAATTGTTA
CAGGTGTATCACTCGTCATCACTTTGTTTATAATCACATCTGATGCTGGCATTGCAACTG
CTTGACGTGATGGTGTCGACGGTAGTTTCGGACCATCTAATCCAGATTCCCCATGTATTT
CAGAAGCAAAGGCAGCTGGTTTAATTAACGGCCTATCCGCACCTTTCGCTACTGCTATAT
CTTGGCGTCCCATAATATCCAATACGTTCAAGGCGTTTGTCGTATTCTTGTCAACTGATT
GATTACCTGCGACTGTTGTTACAGCTAATATCTCTAGTGGACTGTCAATTGCCCCCGCTA
```

TABLE 7-continued

```
AAATTAATGCTATTGCATCATCGTGTCCTGGATCACAATCCATAATAATCTTTCTTTTCA

TTTATATATCCACCTTTCTTAAGTTGTTATCGATAGCTTATGTATATTTATTTATGTGGT

GAATCATGTTTATTTTGAAAAATAGTTTTAACTTCTCATATTTTTGGATACAAACACTA

TTTATCTATTTTATGGCTTATAAATTTATCCGATATGCCTTATCAACCTACCTCGCTAAA

AATAGGATGTCTACATATCTATACCGACTTTTGTCAACTCATTTTCACAACAATATAAAC

AGCAATTTATATGATTGTTACATGATTCAAACAATTTTTATGAAAAATATTTTCATACAC

AGAATATATATTGATATTAAATTTCTCAAAAGCTATATTGAGAATAATTAGGAGGGATGT

TGATGAAATCTTTATTTGAAAAAGCACAGCAGTTCGGCAAGTCCTTTATGTTACCTATCG

CAATCTTACCAGCTGCAGGTCTATTGTTGGGTATCGGTGGTGCATTAAGTAATCCAAACA

CCGTTAAAGCATACCCTATTTTAGATATTACCTTATTACAAAATATTTTTACATTAATGT

CAGCTGCAGGTAGTATTGTTTTCCAAAATTTACCGGTCATCTTTGCAATTGGTGTCGCAA

TCGGATTATCTAGAAGCGATAAAGGTACTGCAGGTTTAGCTGCGCTGCTCGGTTTCTTAA

TTATGAACGCAACTATGAATGGCTTATTAACTATCACGGGCACATTGGCAAAAGATC
LOCUS 11 (D10)
GATCGTCGGCTAAAACTTGATGTGTTACATCTAAACCAAACACATTTATAGTAATCCCAC

TTTCAAAAACACGCTTCGCTGCTTCAGCATCTACCCAAATATTGAATTCTGCTGTAGGCG

TCCAATTTCCAAATGTACCACCACCCATCAAAGTAATAGATTCAATATGCTCGACGATTC

TTGGCTCACGAATCAATGCCGTTGCTACATTCGTAAGAGGACCTGTCGCTACAATTGTTA

CAGGTGTATCACTCGTCATCACTTTGTTTATAATCACATCTGATGCTGGCATTGCAACTG

CTTGACGTGATGGTGTCGACGGTAGTTTCGGACCATCTAATCCAGATTCCCCATGTATTT

CAGAAGCAAAGGCAGCTGGTTTAATTAACGGCCTATCCGCACCTTTCGCTACTGCTATAT

CTTGGCGTCCCATAATATCCAATACGTTCAAGGCGTTTGTCGTATTCTTGTCAACTGATT

GATTACCTGCGACTGTTGTTACAGCTAATATCTCTAGTGGACTGTCAATTGCCCCCGCTA

AAATTAATGCTATTGCATCATCGTGTCCTGGATCACAATCCATAATAATCTTTCTTTTCA

TTTATATATCCACCTTTCTTAAGTTGTTATCGATAGCTTATGTATATTTATTTATGTGGT

GAATCATGTTTATTTTGAAAAATAGTTTTAACTTTCTCATATTTTTGGATACAAACACTA

TTTATCTATTTTATGGCTTATAAATTTATCCGATATGCCTTATCAACCTACCTCGCTAAA

AATAGGATGTCTACATATCTATACCGACTTTTGTCAACTCATTTTCACAACAATATAAAC

AGCAATTTATATGATTGTTACATGATTCAAACAATTTTTATGAAAAATATTTTCATACAC

AGAATATATATTGATATTAAATTTCTCAAAAGCTATATTGAGAATAATTAGGAGGGATGT

TGATGAAATCTTTATTTGAAAAAGCACAGCAGTTCGGCAAGTCCTTTATGTTACCTATCG

CAATCTTACCAGCTGCAGGTCTATTGTTGGGTATCGGTGGTGCATTAAGTAATCCAAACA

CCGTTAAAGCATACCCTATTTTAGATATTACCTTATTACAAAATATTTTTACATTAATGT

CAGCTGCAGGTAGTATTGTTTTCCAAAATTTACCGGTCATCTTTGCAATTGGTGTCGCAA

TCGGATTATCTAGAAGCGATAAAGGTACTGCAGGTTTAGCTGCGCTGCTCGGTTTCTTAA

TTATGAACGCAACTATGAATGGCTTATTAACTATCACGGGCACATTGGCAAAAGATC
LOCUS 12 ()
ATACACAACGGCTGGTTTATGTTTAGCATCGATTGTTTTACTGTCATCGTAAATGCAGC

TAACATCGCTTCATCTTCATTGTCATGTAATGATTTGTGCAAATGAATTTTTTGCATCAT

TAATTGATAATCTTTAGGAATAACTTTAACGACGACATCTTCAATGCGATCAAAATGTTT

TAACACATGAATCGCTCTCGTACTATTCGTGTGTGACACATGTTCTTCCAGCATTTGCTT
```

TABLE 7-continued

```
AATGAATGCTTTTTCTTCTTGGTGTTTAATCTTTGTAAACGAAAGCGTATCTAGTTGATT
ATTTTCAACAAAAGCTTCTACATCAGACGGGATAACGTAAGCAATACCACCACTCATACC
TTGACCGAAGTTCTTACCTACATCACCTAAATTAATGACATGTCCACCAGTCATATACTC
TAATCCATGGTCGCCGATACCTTCAACGACAACATCTACACCACTATTTCTAATACAGAA
TCTTTCTCCTGCACTACCGTTAATAAATGCCTTACCACTTGTCGCACCATAGAATGAGAC
GTTACCAGCAATAATTTCATTTTGTCGTTCTTCAAAAGGTGCTTTGACAATGACCGTACC
ACCAGATAATCCTTTACCAACATAGTCATTCGCATCTCCAGTATGATGAATCATTAAGCC
TTTCGGTGCATATGCTGCAAGACTTTGACCAGCATGACCATTCGTATAAACATTAATTGT
ATTTTCAGGAAGTCCTGCTTCTCCATATTGTTTCGAAATCTCACTACCTGTAATAACCCC
TACATCACGTTGTTCATTATTTACTGTAAAGCTACCTGTATAGCGACGCCCTTCAGCAAT
ATATGGCTTCGTTACTTCATATAAATTTGTTAAATCAAATCCATGCTCAAGATTATGATT
TTGTTGAATTTCTTTTGTGTTTGGCCCATCGAAAGGACATAACAGTTTTTCAACATCAAT
ACTAGCCGCTTTGCTATTCGCTTTTAATGTTGATGATCGTTGTAATAAATCAGTTCTTCC
AACTAAGTCTTCTACACGTTTCAAACCTAAAGATGCTAAAATTTCTCTTAATTCTTGTGC
AATAAAATGCATAAAATTAACAACATGATGTGCTTTACCTCTATATAAAGCACGTAAATC
TTTGTTTTGAGTTGCAACTCCTACTGGACATGTATCTTTATGGCATACACGCATCATAAT
ACAGCCCAACACCACTAATGGTGCAGTTGCAAATCCAAATTCTTCCGCTCCAAGCGCACA
TGCGTACGCTACATCTTTACCAGTTAATAACTTACCGTCTGTTTCTAACTTAACACGACT
TCTTAAGTCATTTAGTTTTAATGTTTGATGTGTTTCTGCTAAACCAATCTCCCAAGGAAC
ACCGGCATGCTGAATACTCGTTTTGGGTGAAGCCCCTGTACCACCATCGTAACCACTGAT
GACAATTTTATCTGCAAATGCTTTTGCCACCCCAGATGCAATGGTACCAACACCTGTTTT
CGAAACTAATTTTACCGCGATATCTGCATCTTTATTCGCATTTTTCAAATCATGTATCAG
TTGCGCTAAATCTTCTATTGAATAAATATCATGATGTGGCGGTGGTGAAATCAGACCGAT
ACCTGGCGTTGACCCTCTTGTCTTCGCAATCCACGGATATACCTTAGTACCAGGTAATTG
ACCACCTTCACCAGGCTTTGCACCTTGCGCAACTTTAATTTGAATTTCTTTGGCATGTTG
TAAATAATCACTAGTTACACCAAAACGCCCAGAAGCAACTTGTTTAATCGCACTTACTTT
GTTGCTTCCATCAACTTGTACTTCATAACGTTTTGCATCTTCGCCACCTTCACCACTATT
ACTCTTTCCACCTAATTGGTTCATGGCTTGTGCTAACGTTTCATGTGCTTCCGCTGAAAT
CGATCCATAACTCATCGCCCCTGTATTAAAGCGTTTGACAATGTCACTTACCGGTTCAAC
TTGGTCGATGTCAATCGGTGTACATGCTTTAAATTCAAGTAAATGTCTAATGTGATCTGT
TCTATTTTTGTTCACCGCTTCAGAGTATGCTTTAAATTGCGCATAGTCATTTTCTTTACA
TGCGTGCTGCAATAAGAAAATAGATTCCGGATTAAAAGCATGATGTTGACCTTGTTGTCT
CCATTGGAATGTACTACCTGATGCAAGATAATTATCATCACTTTGTTGACGTGCTTTATT
TTCAGCATCAATTTGATCAATCGAAATACCAGATAACTTAGACTGTGTCCCAGTAAAATA
ACGATCAATCACATCATGAGACAAGCCAATCGCTTCAAATATTTGTGCCCCTTGATAACT
TTGCACTGTCGAAATTCCCATCTTAGCCATTACTTTAATGACACCTTCTGACAATACATC
CGTATATGTCTTAACATTATCGACAACGGTGCCTTGTAACCCTTCTGTCAATGTCAGTTG
TTCAACTGTACGTTGCGCTAGGTATGGCACAATTGCATTCGCGCCATATGCGAGTAAACA
AGCAACATGATGCACTTCTCGTGTCTCACCAGATTTAGCGACTAAACTTGTAGACATACG
TAAATCTGCTTTAATAAGTAATTGATGCACATGACTTATTGCGAGTAACATCGGCATTGC
```

TABLE 7-continued

```
AAAGCCATTGCTATCAACTAATCCACTATCATCTAACACTAGAATTTGAGCGCCTTGCTT

TACAGCATTCACTGCTTCTCGGCCTAATGCTTCTAACGCATCTTCCAAATCCCCTTCATA

TACCGTTGATAAATAAGTTAATTTAAAATGTTCCTGATCAATCGCTGCTAAGTGTGATTC

ATTCAATACCGGCCTTTTCAATTGAATACGATCTAAAACCGTTTCGTCAGGTGCTAGTAA

GTTACCTTCGCCACCTAAATAAGAAAGTTCACTCGTTACGATTTTTTCACGATACGCATC

AATTGGTGGATTCGTAACTTGTGCAAACAGCTGTTTAAAGTAATTAAATAGTGATTCTGG

TCGCTCGTTCAACACTGCAATTGGCGCATCATATCCCATTGCACCGATAGGATCCTTCTT

ACCTTCTACAAGTTCCTGAATATACTTATGAATCTCTTCTTTCGTGTATGCAAACTGACG

TTGTAATTTAAATAACGTCTCATCTTTCCATTGCGAATCTTGATATTGTATATTTTCAAA

ATCAAAGTCAACTTTATGGTTATCAATCCACGCTTTATATGGTAATTCTCCAGCAATCGC

ACCTTTTAAATCATTATTTTCAATGACTTTATTCTGTTTAAAATCAACAAGCAATAACTT

TCCAGGATTCAATTGACCTTTAAAAGCAACATTACTTTCAGGTACGTCCACAACACCCAC

TTCAGATGAAAAGACAATAAAGTTATCTTTAGTAATCGTATAACGACCTGGACGTAATCC

ATTTCTATCTGTAAGCGCGCCAAGTTTGTCACCGTTACAGAACGAAATCATTGTAGGACC

ATCCCACGGTTCCATTAAATAACTATAAAATTCATAAAACGCACGTACATTTGCATCATT

CGCTTCATTATATAACCAAGGTTCAGGTATGAGTAACATCGCTGCCTTTTCTGGCTCCAT

GGCTAACGATAAGAACTCTAGCGCATTATCTACAATGGCACAGTCACTACCATCCTCATC

GACAATTTGAAACACTTTATGTTGATCCTCGCCAAATAATGTTTCGATTAATTTATGTTG

GCGTGCTCGCATCCAGTTTACATTACCTTTAATCGTGTTAATCTCACCATTATGCATTAA

CATACGGTTAGGATGTGCCCTTTTCCAACTCGGGAATGTATTCGTACTAAATCTCGAATG

CACTAACCCTAGCTTTGATTGATATAAATCATCCGATAAATCTGTATATAGTTTTTTAAT

TTGGTCTGATCGTAACCAACCTTTATATACAATTGTTTTGCGTGATAAGCTCGTAAAATA

CAATTCTAAATCGCACTGAGTCGAATAGAACTCTAATTGTTTTCTCGCTAAAAACAAACG

CTTTTCAACATCTTCAATGTCCCTAATATCAATAAACACTTGTTGAATGACTGGCATCGT

ATCTGCTACATGTTTAGCAATGGCATCTTTATTAACTGGTACATTACGATAACCAAGAAT

TGATAACCCTTCGCCTTCAAAATATTTTTAAAAACTACTTCATGTTCAGAACCTAAAAT

GCGTTCTTTGGAAAAAAATAACCCCACGGCATATTCACCTTCACCTGGGATATCAAAGTC

CGTTACATGTTGTTTGAAAAATGCAAAAGGTATTTCAGTCATAATACCTGCGCCATCACC

AGTGATGCCATCTGCGCCGACCCCGCCCCT

LOCUS 13 (D18)
GATCCATTGTTCGCAGCAGCTGATGTCATTTCATACATAACTTGTGAAATACCATGAAAA

GACGGATTCGTTATACTTTCACTTGCTCCAGGAATCATAAAAGCAAGTGCTGAAAATACT

AAAATTAAAATTGGGTGTATGAGAAAGACTAAGCAATACATTTCATTTCACGGGCGCCA

ATTGGCATATTTAAATATTCTGGTGTTTTACCAACCATCAAACTGCATATAAACACCGTC

AGTAAGACAAATATCAATAAATTCATGAGTCCTACGCCTTCGCCACCAAATACAACATTT

AGCATCATTAATACCATTGGTCCTAATCCACCTATAGGCGTTAAGCTATCATGCATGTTA

TTAACAGAACCCGTTGTAAATGCCGTCGTAATAACTGTAAATAGTGCTGACAAACCTGCT

CCAAACCGTACCTCTTTACCTTCCATATTCGGTCCATAAATGCCTAAATTCGCTAGTATT

GGATTACCACGATACTCACTCCACATAGTTAATGTAAGAATTGCTATAAAAATGAAAAC

ATTGCGACAAATAATATCAACGCATGACGATGTACTCGTTTACCATGTCTACTTAACATG
```

TABLE 7-continued

```
CGACCAAATAAGAACAACATTGACATAGGAAGTAACATCATACTGCCCATTTCTATAAAA
TTGCTCCAAATATTTGGATTTTCAAAAGGTGTTGCAGAATTTCCTGCTAAAAATCCTCCA
CCATTCGTACCAAGATGTTTTATTGATTCAAGTGATGCAATAGGTCCAAATGCAATATGT
TGAATATGTCCGCTTAAAGTCCGAATCATTAAATTAGCATGCAACGTTTGTGGTACACCT
TGAGTCATCAATAAAATACTAATTAAACATGATAATGGTAAAAGTACTCGGACAATAAAC
CGAACAATATCTTGATAAAAATTACCAATGATATTAGTTAATCCAGTTAAACGTCTCAAC
ATCGCTATACAAACGGCGTAACCTGATGCACTAGATGTAAACATTAAATATGTCATTACA
ATCATTTGCGTTAAATATGTCACATCTGATTCACCGTTATAGTGTTGTAAATTACTATTT
GTTAAAAAAGATATTGCTGTATTAAACGCTAAATCTATCGATTGGTTTAAATTATGATTT
GGATTTAAAAAAAGCCATTGCTGAACTATTAGCAATACAAATGTTATAAACCCCATAAAT
CCATTAAATGCCAGAAAATGTTTGACATATGTTTTAGCTGACATGTGTTCTAAATCTGTG
CCGATAATTTTAAAACACATATTTTCAAATCTAGTAAATATTAAATCTACTCTTGACGAT
TGCACCAATGCTACGCGATATAGATATCCACTAAAAACATACGTAATCATAACCATCATT
GTTAGAAACAAAATTATTTCCATGATAACCCTCACTTAATATATTTCTAAAATTTTTCAC
TACGAATTAAGGCATAAAATAAATACAAAACTAATGCAATAACTACCAGTAATAAAACGA
TGAGCATTGCCATAACCTCCTTACAACACAACAACATCGTAACAACTTGTTTATGAGAGA
AATATTAATTTTCAAACTTAGTTATTAAGAAATCATTAAGATGTGTATGCAGAAATAAAT
TTTATAGCATTTAATTGTGAAGAATATTATGATATTGCTATCGAGGTGAAGGTTATGTCA
AACACTGAATCGCTAAACATAGGAAAAAAGCGTGGATC
```

LOCUS 14 (D21)
```
GATCACTGCATCTCCATCATTAACACCGTCATTTTGATTCTCAACGATGAATGGTACTAC
GAATTCGTCAGTTAAGCCCTCATTATAGCTTGCTTCTACACCTTCTTTGGCAGTTGCATA
AGTTGGGGCATCAAAATTACGAATAGCATTGTAAGCTTTTTCTTCACGTTCCCAACGTTT
GTCACGATCCATTGCATAATAACGACCAGACACAGATGCAAATTGACCAATGCCTAATTC
ATTGAATTTAGCTTCAGTCTCTTCGATGTATTTCAAAGCGGATTTTTGATCTACGTCACG
GCCATCTAAAAATGCGTGTACGTAAACTTTTTCAACACCTTGTTTTTTAGCAAGTTCTAA
CAAAGCAAATAAATGTTTGTAATGACTGTGTACACCACCGTCAGACAATAAACCAAAGAT
GTGTAACGCTGAATCATGTGAATTCACGTGTGCAATTGCATTATTTAAAACATCATTTTC
AAAGAAATCACCGTCTTCAATTGATTTATTGATTCGAGTTAAACTTTGATAAACGATACG
TCCTGCACCGATATTCATATGACCAACTTCTGAGTTACCCATTTGTCCTTCAGGTAGTCC
AACATCTAAGCCACTCGCTTCGATTTGAGTCGTTGGATATTTGTTGTAATAACGATCAAA
ATTAGGCTTGTTTGCTAATTTTACCGCATTACCATGTTCGCTTTCGCGGTTCGCAAAACC
ATCTAAAATAATTAACGCAGTTGGTTTCTTAGCCATGATTATTTTGCACCTTCTAACAAT
TGTACGAAATCTTCAACTTTAAGTGATGCGCCACCTACTAATGCCCCATCAATATCAGTT
TGTGCCATGTATTCTTTAATGTTGTTAGGTTTAACACTACCACCATATTGAATACGAGTT
GCTTCTGATACTTCTTTGCTTGATAAGTCAGCAATAGTTTGACGTACAAATGCACACATT
TCATTTGCATCTTCAGATGTTGATGATTTACCAGTTCCGATTGCCCAGATTGGTTCATAA
GCAATTACAACTGATTTAAGTTGATCTTCAGATAAACCTGCAACAGCTTTCTTAACTTGC
TCACCTACAACATCGTTAGCTTTACCACTTTCACGCTCTTCGTCTGTTTCACCAACACAT
ATAATTGGAGTCATTCCATGTTTGAAAATAGCGTGCGCTTTTTTGTTAATTTCTTCATCT
```

TABLE 7-continued

```
GTTTCGTGGAATAATTCACGACGTTCAGAATGACCGATAACAACGTATTTAACGCCTAAA
TCTGCTAATGCAACTGGAGACGTTTCACCTGTGAACGCACCATTATCTTCGAAATACGTA
TTTTGAGCACCGATTTCTAAACCTTGTGCTTTTCCTTCTTTAACTGCAGTAGTTAATGCA
TCTAATTGAATTGCTGGTGCACAAATTACTGATTCTACTTCTTTTGAATCTGGTAGTGTT
GGTAATGTATTGACGAAGTCTTTTGCTTCTTGTACTGTTTTGTTCATTTTCCAGTTACCA
GCTATAATTGGTGTTCTCATTAAAGACACTCCTTGTTTTGTAAATATTTTTGAAAAGTGA
TGAAACACGATGTCATCTTGTGACTGTTTTCCCGTAACAATGTTAAACAAACATGCCACA
TCACTTTAAACTATCACTTTATTATTTATTATTGATTGCTTTGATACCAGGCAATTCTTT
ACCTTCTAGGTACTCTAATGACGCGCCGCCACCAGTTGAAATATGAGTGAAGTCATTTTC
AAAACCTAAAGAGATTGCTGCTGCAGCTGAATCACCGCCACCGATAATCGTAATTGCATC
TTTAAGGTTTGCAATTGCTTTACATACACCAATTGTACCTTGTGCAAAGTTACTGAACTC
GAATACACCCATAGGTCCATTCCATACAACAGTGTGCGCACCTTCTAATTCATCGTCAAA
TAATTTTACAGTGTTTGGTCCAATATCCATACCTTCTTGGTCTGCTGGAATTGAATCAGA
TGGTACTACAGTGATTTTGGCATCATTAGAAAATTCTTTAGCAACTTTAGTGTCTACTGG
TAATACAATTTTATCACCATGTTTTTCTAATAAATCTTTTGCGAAGTCGATTTTATCTTC
TTCTAATAATGAAATACCAATTTCTTTACCTTGCGCTTTTAAGAAAGTATAAGCCATACC
TCCGCCGATGATAATTTTATCAGCTATGTTAACTAAGTTTTTGATGACATTAATTTTGTC
AGATACTTTTGCTCCACCTAAAATAGCAACAACTGGTTTATGTGGATCGTTAACTACGCC
GCCAATAAACTTAATTTCTTTATCCATTAAGAATCCAGCTGCAGTTTCTAAATGTGTAGA
AATACCAACATTAGATGCATGCTCACGATGCGCAGTACCAAAAGCATCATTTACAAACAC
ATCACCTAAAGATGCCCAGTATTTACCTAATTCTGGATC
LOCUS 15 (I1)
GATCCTGAAACGTAATTAATTGAAACTGTAGAACCTTCAGTCACCTTGTTGTCTTTTCTA
ATCACTACTACTGGTAAATTTAAAATATTAGCAACCGCATTTGCCAATGAAATACCTTTT
GTCGCAATGGTAACAACAGCATCTAATTTTTCTTCCATGTAAATACTGGCAATTAACTTA
CCAACTTTGTTTAGTAGCGATGGATTACCTACCAAATCTGATAAAAATAAATATCCGCCA
GGTAACAAACGTTCTTTCTCTTCTAATAGAGTAATGACCTCATTAACAACTTCAGTCGCC
TCTTCTTTACTCATCATTGGTTTATACGTAACACCACCACTTGCGCCAGCAGTAGTAATT
ACTGTACCTAACTTTTCTTTTTGGAATGTATTTTTTATAATTTGGACATCTTCACTTATT
GAAGACTTCGCCTGTTTAAATTTTTTCACAAAAAAGTTAATGGTAATCAATTTATTCGGA
TGGTTCATCAAATATTGCGTCATAAAAACAATTCTCTCGCTTCGTTTATATCTCATCTTT
TCAACCCTTCTATCCTAATAGTCTAACTAAGTACACTTCATTACAACAACCGTTAACTGC
ATTATAAATATTTTTGCTTGGCTTTCTTTTCGTGCTAGCCCATACACAGTAGGTCCGCT
TCCACTCATTAACGCACCATCTGCACCACTTTTCAACATATTATTTTTTAATTTATCGAT
TTGTGGGTGTTTTGAAACAGAAATTGGCTCTAATCGATTAGACAAACTTTGACATAATTG
TTGATAATCTCGATTTTCTAAGGCCTCATAACACATTTTCGTATGTACGTCGTAACGCTT
ATCTAAATTAATCAACTTAAATATATCTGGTGATGATATGCCTAAGTTTGGTTTAGCAAG
AATCACCCAAGCTGAAGGTGGTTTATTTAAAAACTCGATTTTCTCTCCTCTTCCAGTACA
TAGTGCAGTTTTATTATAAATACAAAACGGAATATCTGTCCCGATTTTACTGCCTAGTAG
AGCCAATTCTTCCAAACTCGCCCCTATATCAAAAAGTCGATTCAATCCTCTTAACGTTGC
```

TABLE 7-continued

```
TGCTGCATCAGCCGAACCTCCAGCTAAGCCAGCAGAAACAGGTATTTCTTTATCGATAGA
AATTGTTACACCTTGCTTTAGTTGATATTGCTCAATAAATAGTTGCGCTGCACGATATGC
GAGATTTTTATGATTAGAAGGCACATAATTATGTTCAATCTCAACAACTATCTTTCGATC
TTTTCTTTTATGAAAAGTTAAACGATC
LOCUS 17 (I3)
GATCGACAACACTCTAAATATATAGAAAATAGGTATTAATTTAACTATAAATCTAAATAA
TAATGCAAAGATGATTAAAATAACGATAGCTAAAGCAATACCAATAATAAAATCTTTGGT
CGCTAGCTCACCTATCATCCCCATATAGAAAATGATAACCTCGACACCTTCACGCAACAC
AGATATTAAACCAATCGTCGCTAACAATACCAAATTACCATTACTAATCGCATTAGCATA
CATATTTTTAATCATGTCATTCCAACGTTTTGCATTTGAACGTTTGTGCATCCAAACACC
AACGATAAACATTAATATGACCGCAACGATACCTAATCCCGCTTCCATACTTTCACGAAG
AATGCCACTATTCCCTAAAGTTTCTACAAACGTAATTGCTAAGATAATACTCAGTACAAG
TCCGGCAATTGCACCACCAATCACACTTGCAGTCCCTTTCTTATCTTTTACATTACGCGT
CATGGTAGTCAATGTCATTACAATTAACAACACTTCTAGCCCTTCACGTAAAAAGATAAT
CATCACATCGACGAAGCTATAACTATGGCCAACAACCTCTTTAATTTGGTTATTTAAATC
TACTAAACCATCTTTCACATGTGCTTTATTATGTTCGTCTAATACACTTTGATAATATGG
TATTTTATCTTCAATTTTCGTATACAAAGCACCGTCTTTAGTTTGAATTTGACCTTCAAC
ATACGGCCAAGTTTCTATAAAATGTGTAAGCGCAGCATCAGCATCCGACAATTGATTGTC
GTCGATAGCTTTAATCGCCTTCTCTAACGCATCATTTAATTGTGATACATGGTATTGATC
ATTTGCAGACGTATTACTTTTTTTATCGACATGATCAATATTTGATTTAAAAGTTGTCCA
AGCATGTGACACTTTTGCCGTATCTAATGGTGACTTATGAATTGCAATTCTAAGTTGTAA
TAATGCGACTTCAATTTGTCCATATTGATTTGCGTCATAATTGCGAATCACTGTTTCATT
ACTTGTCCAAATCTGATTCAAACTATTGTTCAAAGATTCTAATTCCGCTTTATTTTTATC
TTTAATCGCTTTTGTCATCGCAGCATCTTTAGCATCGACTTGCTGTTGCAATAGTTTAAT
TTTAGAACCCGCATCTTTACTAGCCAATTTCTCTTCATAAGCAATTAATGACTTCGTTAA
TTGCGAAAGTGTATCTTTTTGATTATCATTCGCTTTTGCATCTTCAAGCTTTCTCACATC
TGATTTGACAGCATTACTTTCACTATTATCTTCAAGCGATAATTTCTTAACTGCACTTAC
CACTTGCTCAATTGCTTTCTGCTTATTGTCATTCGATATCGAATTATTAGAAAGTGCAGA
TTTCGCATCCGTTATCACACTATATACATCACTAATACTTTGTTGTTCTGCTGCCTGACT
TTTCAGTAACCCAAAGCTACACACCATAGCAGCAGTTATTAGCATTCCTACAAATTTAGT
CAAATAATGTTTCACCAAGGTATCCTCCCTTACTAACACCTGGTAATACTAAAAATGAAG
CAGAACCTCTATGTGTAATATATTCATTTAATTTATCATTACTACCTAAATTATTTTGTA
TATCGATAAATTGTTTTGTCGCTTTTTGAAAAGCAATAAAAAGTAAGCCTGTTTCGAAGT
TACCTGTGCGGTCATCCGTACCATCCACATAATTAAAGGCTCTACGTAAAATTGACGTAT
TTGCTTCTTTCGCTAGCCTCGTATGGGCATCTTTATCAATAATATACTCGCCATGACTAT
CTTTCGCTTTTAAGTCAATTTCATCAAACTCTTTCCCACCTGTTAACGGTGCACCACTAT
GTCGTTTCCGACCAAATGTAGCCTCTTGTTCTTCCAGCGCAGTACGATC
LOCUS 18 (I5)
GATCGTTTAAATGTTCAATATATTCCGCTGCACTTTGCGCTCCAATACTACCATCGCCAG
TAGCAGTGACAATTTGGCGTAAACCTTTGTCGCGAACATCTCCTGCTGCAAAAATACCTG
GTACTGATGTTGTCATATCATCTTTTGTTACAATATAACCAACATCATTTGTAATACCTA
```

TABLE 7-continued

```
AGTCTTTAAATGGCGCTGTTAATGGTTTCATACCAATATAGATGAATACACCATCAGCCT
CGTGTGTTTCTTCTGAACCATCTTTTGTAGACGTTAATGTCACAGAACCCACTTTGCCGT
CTTTTTCATTAATTGATTTCAAAGTATGACTCCAAATAAAGTCGATTTTATCATTTTTGA
ATGCTCTATCTTGTAAAATACGCTGTGCACGTAACTCATCACGACGGTGAACGATTGTTA
CTTTGTCAGCAAATTTAGTTAAGAATGTTCCCTCTTCTACTGCTGAATCACCACCACCGA
TAACGAATAGGCGTTTATTTTAAAGAATGCACCATCACATACTGCACAATAACTTACAC
CGCGTCCACCAAGTTCTTGTTCACCCGGAACACCAATTTTCTTGTATTCTGCACCTGTAG
CAATAATAACCGCTTTCGCTGTTAATTCTTTATTACCAAAGTTAATCACTTTATATTCGC
CTTTATCTTCTACAGATTTAATATCTCCATATTGATAAACTGCACCAAACTTTTTAGCGT
GTTCAAACATTTTTGTAGATAAATCTGGACCTGTAATCATTTCGAAACCAGGGAAGTTCT
CTACTTCTTCTGTATTAGCCATTTGACCGCCTGGAATACCTCTTTCAATCATAACTGTTT
TTAAATTAGCACGTGATGCGTATACTGCAGCAGTCATACCAGCTGGACCTGCACCGATAA
TTGCTATATCAAAATCTATTTCAGTCATTTTATTAACGCCTCCTCATTATTAATCATTAT
GCGCATTATATAATAAATCTAACTTTTCATAAATCTATATGCTCAAGAGAAATTCAATCA
TTTTGTTCAGTTTATATTGTGTTATGCCTAACCATGTTGTAATTTGCTTCTTTGTAACGT
TTCGAGGTTGATTTTTAAAATACAAATAAATAAACGCACCGATATATGGCTCAACATCAG
TTAAATCTACTTTTTCAGCAATTATGAGTTCACCTTGATTAATCCATGCAACCATTACAT
CATTTTCACTTACAAATAATTCATTATGGTAAAGCGTTAATAAGCCGCGATGAATGAAGT
CTAATTTATTGAGCGTTAAACCTTGAACTAAATACGTTAAATACAATTTCTCATAATTAT
TTAGATTTTCCAAAACCTGCCAAATACTTTCCGTCATCACAATTTCTTTACCATTTAATT
GATC
LOCUS 19 (I8)
GATCGTTGATTTGATTAGTGATGGTTGAACAAATTAAAAATAAACTACTTACTGCAAATA
CTACGCCCATAACGATAAACGTAGTAGCTGGTGTAGTATAACTTGTAATGCCAGCGCCAC
TAAGACTGCCAATAATTTGACCAACAACTAACATACTGTTCGTCGTTCCAACAAATGTGC
CTTTAAGTTGTTGATGACACGCATTCACGACAACAAACATGACACTTTGAATCAATGCAC
TATATGTTAATCCTTGAAGTATTCTTGCAGCCATTAAAAACTCTATATTCGTCGCTAAAC
CTTGCAGTATCGCACTACAACCACATGCAATCGTGGCAAATATATATACTGATTTAACAT
ATGATTTATCATTAAAGCGTCCCCATAAAGGCGCGCTTAATATCGAAGCCGTCCAAAATG
CGGACTGTAAAAATCCAATCACACTACGGTCATCTATCGCTGTATGATTCACTGATGAAG
CAAGTGGTGATAATGCAGTTAGCATGCCATACATAGCAAAGTTTGCTAAAACGCCAACGA
TAATAAATCGACATGTTTGTTGTGTGCATAATAGACATTGAAATGAACGGCGAATACCTT
TATTAATATTTGGTGTTTGTGATTTTGGCATATGTGTCGTTTCAATCAATTTTAATGCAC
CGAAAATACAGACAATAAAAGTAATAACGGCAATACTCATCAGTAACGCACTAAAACCTA
ATATCGAAGCTGTAACACCGCCAATTAATGGCCCCACAAGAGACCCTGCGCTGACTGAAC
TTTGCAGTCTTCCTAATACCTTTCCACGATCTTCAGCTGGCGCCTCTGCACTCGCAAACG
CACTTGATGCATCAACAACACCACCAAATAGTCCCTGCAATAACCTCACAAGTACAAACT
GTAATGGTGTCGTACACAATGCCATTAAAAATAAGCATACCGCCAAACCAAGTAACGCTC
TTAACACCATCCATTTTCGGCTGATCTTATCACCTAGCTTCCCCCATATCGGCGAAGCTA
TCATCGTCGTTACAGCTGGAGCAGCAATCGCTATACCACTCCACAACTGTATTTCTACGA
```

TABLE 7-continued

```
CTGATAGATTTTGTAGTGATGCCATATAAATTGGCAATAATGGCACAAGTACTGTCAGTC
CAGCAATCGCTATAAACTGACTGAGCCATAAAATGCGAAAGTTACTGCGCCATATAGACT
GATTAATCATATGTCACCATTGGATTTGCTACGGTAGTTAAACCTGAAGGCATACTACCT
CCACCACTATCACGTTGATATAGCAATGGTAATAAAATTTGTTTGAATGGCCACGTCTGT
TTATCAAATAAAATGTGTCTGACAGCTAGCTGATCAGTTGTAACCCAGGAAATAGTTGCC
ACTTCATTTTTTAAAATTTGTTTTAACAACGACATAAGTTCATGCTCACTTACACCAAAT
AAATCTTGAATTGCATCAATAATGGCATATAGATTTACCGATACAGCTAATGTTTGAAAA
TAAGCAAAGAATGTTTCCAAATCCTCATTAATTAGCGTATTAGGTGTATCTTCTCTGACG
ACATACTTCGGCAATGAAAGCTGATGTGCTGTTAGCCATGGTTTATAAATTCTGACAGTA
TCATGATCACGTAACACGCATTTTTGTACACGTCCATCTTCAAATGACAACAATATATTT
TGACCATGCAACTCTGGTAATGCGCCGTATTGCATAAATGATAGTGTTACCTTTAAAAAG
ACTTGCGCGATATCTTCAAATAACGTCATGACATCATTTTTAGAAATATTATCTTTTCCA
CAAATCATTTGATATAAAGTGCGATCATTTGCCGCGAGTGCTGCCATTGACACTAGCTGT
TGCGTATCATTTTTGGCTAGCACTTCGGGATACTTTCTTAGCTGAACAGTTAGATGACCT
AATTGATCTTTGAAAATATCATTATCTTGACCCATATATGACCACCAAGCTGTTTCATCA
CAAACCATGACATACTTAGCTAGTGCTTCATCTTTTTCTATAAGCTGACGTAATAATTGT
TCTGCTTGTTCTCCGTTTTTCATGTAACGCGTAGGCGTTAGCCTTAATGCGCCTAATGAC
TGCATTGCAAATGGTACTTTGACATGGTTATACGGTGCGCCAATATCAATTAATGAACGC
ATACTTGAAGACGACAGATAATCTCCAAATTTTAACGGTAATAGTACAACCAACTTTTCA
CTAATCTCTTTCGCAAAGACGTTCGGCAGAATATGCTGATATTGCCAAGGATGTACCGGA
AATAGTACATAGTCATCTATTGATAACCCTTGATCATTTAACATGTCTGTCGCTTGTTCT
TTTATAGGTACTGTCAAATTTTCTAATTCATCGATATTTGCAGTATCGCCATGAATCATA
TGTGTCTTTTTAACTGCTGCAACCATTAAAGGAAATGATTGATTTAATTCAGCTTGATAC
ACTTGATAATCCGCTTCTCTTAATCCTCTTTTTTCTTTAGCTAATGGATGAAATGGACGA
TCTTTTAAACTTGCAAACTGCTCTGACATCACAAAAGGATGTGACGCTAAATCTAATTCT
GATAATTGTTTAGCAAGCTGTGTGGCAGCAGTAGTCAGTCCTTCTTCAACGCGAGCCACT
TCCCATTCATGACTTAGATCACAATTCATATTAGCAATTGTTTGCCAAAATTCAGCTGCC
GTTAAAGGTTGCTTAGACACCCTTCCCTCTATCGTAATTGGTTGTGAACTTTCGTAACGA
AACATATTTAAAGCACTAAAATAAACAGGTATCTTTATTTGTTGTGTTTCACGTTCGTAT
ATCAAAAGCGTTTGTCCGTTTTCTTTAGTAATCTCACTATTCGATACAATTCCGGCTATA
TCTTCAAATAATAATGCATCAACTAAATCTCTTAATATTATCGCTTGTGCTGTATTGACT
GCTGTATGATTCTGCAATGTTCAGACACCTCGCATTCTTAATATAGGTTCAATGTTGTCC
CAATATTTTGTTGTTGTGCCTGTTGATAAATAAAATAAGCACTTGAAATATCTTCGATAG
CCATACCCATCGGATTAAGTAATATGATC

LOCUS 20 (J7/M10)
GATCGCTTACAAAACATAACAAGCTTTAAAGATATTGCCAAAATTCTTTATTCAACGAGA
GCAGGCGTTGCTTATATGGCTACAGGTGGTATGGCTGGCGCTTTACGTGCCACATTAGAT
TATGTCACTGAGCGTAAGCAATTCGGCAAACCAATTAGTAAATATCAGTTAATACAAGAA
AAGCTAGCAATGATGCAAGGTAATTTAGCTCAAGCAATGGCAACATGTGCTCAATTAGCT
AATATGCAAGCACATGGTGAATATGACGAGGTTGCAACTTCAACGGCGAACATGATGAAT
```

TABLE 7-continued

```
GCCTTACGTTTGCGTGAGACAGTAGCTATGGGCCGCGGTATTACAGGTGGTAATGGCATA
CTAGCTGACGATTATGATATTGCACGTTTCTTCTCTGATGCAGAAGCGATTTACACGTAC
GAAGGTACACATGAAATTAATGCCTTAGTAATTGGACGCGCTTTGACTGGAGATTCTGCT
TTCGTATAAATAGCAAATAATTATATGAGATGCATTAATTTCACTAAAAAAGACTTATTT
TAAGCATAAAGCTTTTTCCTTAAATAAGAGGCTAAGATGACTGTCAAAGATACTTAATTA
ATTTTATAAAATAGCAACGTTATTCCAATTATCTTAATGGTTATCTTATCCTCAACTAAA
TTGGAGGAATCACTATGACAATTAATAAAGTAACCGTTCTTGGCGCAGGCACAATGGGCG
CTCAACTGGCAGCACTTTTTGTGAATGCTGGACTTAAAGTAAAACTATTAGATATTGTAG
TGGACAAAAACGATCCAAATCTCATTGCGAAAAAATCTTACGATAAAATTACAGATAAGA
AACGGCCGCTACTATTCGACTTAAATCTAGCGAGTCATTTAACATATGGTAATTTTGATG
ATGACTTGGTAAATGATGATGCTGATTTATATATCGAAGCAGTCAAAGAAGATATTGAAA
TTAAGCATGGTGTTTGGCAACAAGTTCTACAACATGCTAAAGAAGATGCTTTATTCGCTA
CAAATACATCAGGTATTCCAATTAATGCGATTGCTCAAGCATTTAACGAGAAGGATCAAG
AACGATTCTTTGGTCTACATTTCTTTAACCCACCACGTATTATGAAATTAGTGGAGTTAA
TACCTACGTCACACACGAAGGAATCTATTATATTAGATGTAAAAAATTTCGCGCAAAATG
TGTTAGGTAAAGGTGTCATTGTCGTCAATGATGTGCCTGGCTTTGTCGCAAATAGAGTCG
GCACGCAAACAATGAATGATATTATGTATCGCGCCGAGCAACACAAGATAAGCATTGTAG
ATGTGGATGCTTTAACTGGGCAAGCGATTGGTCGTCCTAAAACAGGTACATATGCGCTAT
CTGACCTAGTCGGTTTAGATATTGCAGTCTCTGTAATTAAAGGCATGCAACAAGTACCTG
AAGAAACACCTTATTTTCATGATGTCAAAATTGTAAATACGTTGTTTGACAATGGCGCAC
TCGGACGTAAAACGAAACAAGGATTTTACAAAAAGGATAAAGAAACTAAAGCTCGACTTG
TTTACGATGTTGAAAAACAAGATTATGTACCTGTATCGCAACCACAATTACCAATTTTAA
ATGAATTTAATAAAGACTTAGTGCATAACCTTGATACCATATTCAATGCGCAAGACGAAG
CGGGACTATTTTTATGGGAGACATTACGTAATAATTTCTATTACTCTGCTATCAATGTAC
CTAAAGCTACCGATGATTTCCGAGACATAGACCGTGCGCTTGTCTGGGGGTTCAACTGGA
AACTTGGTCCATTCCAATTATGGGATGCAATGGGATACGAACGTGTTAAAACACGTATGG
AAGACGAACTTGGAGACTTACCACAATGGATTAGTGATTTAGATGGTGGCTTTTATAAAC
AAGATGAGACCATTGAATATGCAACACCTATTTCTCACTTCGTAAAAGATGAACTTTGGG
ATAAAGGTGATGCCAAACTTTCCGTAACTCATGATGATCAACTGTTACTGAAATTACAAA
GTAAAATAATGTCATTACCGATGAATTCAACGATGCGTTAGTTGATGCGATTGATTTAC
TGGAAAATGACCATTACACAAGTATGGTTATTTATGCAGATGGTAACAATTTCAGTGTGG
GTGCTAACCTTTTCTTAATGAAAAAGGCGCATGAAGACGGTCTTGTAGATGATGTCGTTG
CACAATCAATTGATAAATTACATTATAGCTTTAATCGTTTGAAGTATAGTTTGAAACCAG
TAGTCACAGCTGTTCAAGGTCGTGCCTTAGGCGGTGGCTGTGAGCTTGTACTTTACTCAC
CTATTGTTGTCGCTGCAAGTGAAACATATATCGGTCTTGTTGAAGCAGGTGTTGGCTTAT
TACCGAGTGGCGGTGGCCTTGCAGAAATGGCTGATCGCATATTACGCACATCGCATAAGT
TTGATGACAAACAAGCTTCCATGACAAAAGTACTGACGAATATCGCATTTGCGAAAGTCT
CTACAAATGCCTTTGAGGCACGTCGTTATGGTTATTTACGTGATACAGATACGATTATTT
TCAATACAGCACAACGTGTCGAAGTTGCGCTCAAACGTGCGAAATATGAAGCAGAAACAA
ACTATATTCCGAATCCTAGACATCAATATATCGCTTTAGGTGAAGACTTCAAAGCATTGA
```

TABLE 7-continued

```
TCCAAGGACAATTAGATGCGCAAAGACGGGGTCATTTTATTAGCGACCATGATTATCATA

TTGCCTTAAATATCGCCACAATTTTAGCGGGTGGTGATTTACCAAGAAATACATTTATCA

ATCAACGTTACATTCAATCGTTGGAGAAAATTGGCTTTATTGACTTACTAAAATCTAAAA

AATCATATGAAAGAATTGCACATATGTTAAAAACTGGTAAGCCATTACGTAATTAAAAGA

TAGTCATTAAGAGAGGATGATAACCATGCAAGAAGCATACATTGTAGCTTATGGGCGTTC

AGCCGCAGCGAAAGCAAAGCAAGGCGCATTATTCCACGAAAGACCTGATGATGTCGCAGC

CAAAGTATTACAAGGCGTATTGAAACGTATTGACGGAAAATTCAATAAGAATATGATTGA

AGATGTCATTGTTGGTACGGCTTTTCCAGAAGGATTACAAGGCCAAAACATTGCACGAAC

GATTGCATTGCGTGCGGGATTATCTGACACGGTACCGGGTCAAACAGTGAATCGCTACTG

CTCATCAGGATTACAAACCATCGCGATTGCAGCCAATCAAATTATGGCTGGTCAAGGAGA

TATACTTGTAGCTGGTGGCGTTGAATTGATGAGTGCCGTACCAATGGGTGGCAACGAGCC

CACAAACAATCCAACCTTACAATATGATGATATAGGTGCGTCATATCCTATGGGTTTAAC

TGCTGAAAATGTAGCATCCCATTTGACGTATCACGCGAAGATCAAGATGCTTTATGCTGT

CAGAAGTCATCAACGTGCCTATGACGCACAACGTGATGGTCGGTTCAAAGATGAAATTAT

TCCAATACAAGTAAACTCAGTTGAATATACAAACGCAGGACCAAAAGTACACACAAATAT

CTTTGACCAAGATGAATTTATACGCCCTGACACCACGATGGAGGCATTAGCCAAATTACG

TACAGTATTTAAAGCTGACGGCACTATGACTGCAGGAACATCTGCCCCACTTTCTGATGG

TGCAGGATTTGTAGTTTTAATGTCTGGAGATAAAGTGAAAGAACTCGGCGTGACACCTAT

TGCACGATTCGTTGGTTTTAAGGCAGTAGGCGTTGACCCGAAAATTATGGGTATTGGGCC

TGCATATGCGATTCCTGAAGTATTGTCACTCAGCAATCTATCTGTTGAAGACATTGATTT

GATCGAATTGAACGAAGCATTTGCTTCTCAAACGATTGCATCTATTAAAGAAGTAGGTCT

AGATATATCACGTACGAATGTGAATGGTGGCGCTATTGCTTTAGGTCATCCATTAGGTGC

TACAGGCGCAATGTTAACCGCGCGTTTACTTAATGAAATGGGTAGACGTCCCGATAGCCG

TTACGGCATGGTTACGATGTGTATTGGTGTCGGCATGGGTGCAGCTGCTATATTTGAATA

TGTGCGTTAGAATGGTTGATTTTGGATGAAGCGGATTCGTTTTGTTATTGAATGAAGTAG

GCTGAAGTTGAAGCCAGTTGAAGTTGAAGCGGGTTGAAGCAATTTCGTTTTATTAATGAA

GCTGTGTGAAATATAGTGATTGAACAAAAAAAGTGGTTTAATGGGATGGTGGTTATTTCC

GTTTTAGAATTTAACATTTACACGTCTAATTTTAATCATTGTTTTAAATTTTATGAATCG

AAGCCCTTTGATTTAATAATATTTGCTAATGCTAGTAACTTATCTGATTGTTCATGTTTA

AAATAAAGAAAACCACTCACATCAGTGTGTGTTCGAACTAGACTTGTAAGTTCCAGTTCG

GCACGACTTTCTAAAGCAATTATTATTGCTGTGATTGTCGTATATCACTTAGATGTGCGT

GGTTTATTTTAATAGGTTAGTAATATATTAGGTCATGTTATGTTTAAGACTATAATGAAT

AAATAATTTAGAAATATGCTTCCGATTGTTCGATGCTTTAATTCAGTTAGAAGCATCATA

GAATGCATGATTACTGTTGTAAAGATACGTAATGTTTTGTATTGACTGTATGTCTTTGGA

TAGAGTTACAAACTTATTTTGTTACTCTAGGCCCATATGTCGCAGTACCATCTGCATGTG

TTGTTACATTGTATGCATTTGTTTTACTTGGCTTCTTGTATGTCGGGCGAGCTCCGTATG

ACACTTGACCGTTTGCATGTGTTGTTACGTTGTATGCATTTGTTTTGCTTGGCTTGTTTT

GTGTTGGGCGAGCGCCATATGATACTTGGCCGTTTCCATGTGTTGTTACGTTATATGCGT

TTGTTTTGCTTGGCTTGTTTTGTGTCGGACGAGCTCCGTATGATACTTGGCCGTTTGCAT

GTGTTGTTACATTGTATGCATTCGTTTCGCTTGGCTTCTTGTATGTCGGACGAGCTCCGT
```

TABLE 7-continued

```
ATGATACTTGACCATTTGCATGTGTTGTTACGTTATATGCATTTGTTTCTGATGGCTTAT
TGAATCTTGGTCTCGCTTCATATCCAAATGTTCCATCGTTGTATTCACGGATACCTGTAC
CAGCATCTCTATATTTAACATATTTAGGTGTTTTGTTAAATTGCGGTCTCGGACCATATT
GAGAAGCTTCTGTTGTTTCAGTTGCTTGAGGTTTAACTTCAATATCACTTGATTCTCCTT
GAGTACCTTTTAACGTTGATTCAGTACCTTGTGGTTTTATTTCAAGTTTAGATGAGCTAC
CTTCAAGACCTTCTAAAATAGGGTTCGTTAACGGTGGGTTTGTATAATTATTGCTTAATG
ATGGGCCGCTTTGTTCCATTGTTAGAAAATCGGGACCTTGAACGATTTCACCTTGTACCG
TTTTATTTTCCATCGTTGGATATTCCGGACCTTTTACAATTTCACCTGTAATTGTGCCCT
GTGGAATTTTAACTAATGGTTGTGCAACTGGTTGTGTTGTTTCTTCAGCTTTACCAGCCG
TAGTTTTAACCTCTTGTTGGTTATCAACTTTAGGTGCTTGAGGTTCTTCAACTTTCTTCT
CTTCTTTTACTACTGGCGATTTTGTTTCAGTTTCTCCGTATTTTTTGACAGTTTTCTTTT
TCCAAGAATCATCTGCTTCTTTAACTGCTTTTTTCGTTTCTTCAACTAATTTATCAAAAT
TAGGTTTATTATCACTATTTGTTTTATAGTTATGTGTTGTAGGATTATATTTCGTTATAG
ATTTCGGTCTATTTTGTTTAGTTTCCATAAAGAAATCATCAATAATTGAATTTAAGTCAT
CAATCATTTCTTTTTTAATACGTTCATTTGTAATTTTATGTGGATTGTCTGTATCTCCAA
GGATTAAGTCCAGTTTTGCTCGTAACTCTTTCGCGTGCTCCCCATAATCCTTATCACCAT
AATATGATACAACTAATGTATCAATTTCAGATACGAGATCGTATACTTCCTTAGTTGCTT
TATCTTCTTCTGCTGCATTAAAAGTTTTCAAGTCTGAATTCTTATCCTTAATATCTTTAA
CTTCTCTGTGAAAATCATCCAGTGCTCTCTTTAATGCATCCTGTAGTTCATTGTATTCTT
TCATCGAAAGTTCTTCTAAATTATATTTATGAAAATTAGCCATTTTTAAATCTGTACGAG
GATTTTCTTTTTATAATTTGCATACCATTGTTTATAATCTTCATATTGAGATTTCTTTC
TCTCCAAAAGATATTGATCTTCCCTTAATACCTTTTCCAACAACCTATCTTTAGCTTCTT
TATAAATATTATCTCCATATTCATATTTATTAGTTAATCCTATAGCATAAATTATATAGT
CTTCCAAATAATATAGAGCTGAATTTAAATATCTGCTATCTATTAATGTCCCATTTTTAC
TCCCAGCATTAACTTGTGATTTCCCACTATAATCCTTTGTTACTATCGCATCTGCTTTGT
TATCCCATGTAAATAAGCTAGATGCAACTGCTAATGCCCCTAGCGAAATTATTTGCTTTT
TCATAATTTTTTAATTCCTCCAAAATGTAATTGCCCAATCTACATTAAAGAAACAAAATA
TTAAAAGACATTAACTATATATTAACTAGAATAAACAAAGCATTAACTATCTTTTTGTTA
TAGTTAATTAGCTTTGCAATATACAATAGTGTATAATTTTTTGATTAATGTACATCAAA
GGAGTAACAAAGCATGACAACACAAATGAAAATCAAAACATATTTAGTTGCTGGTATTAA
AGCGGCGCTCCTTGATACGACTGGTATTAAATTAGCAAGCAAATCTGAAACTACATCACA
TACGTATCAACATCAAGCGCTTGTAGATCAATTACATGAATTAATAGCAAACACTGACTT
AAATAAATTATCGTACCTAAATTTAGATGCGTTTCAAAAACGCGATATTTTAGCTGCGCA
CTATATTGCAAAATCCGCTATACGCACTAAAAATTTGGATCAAATGACTAAAGCGAAACA
AAGATTAGAAAGTATTTACAATTCAATTTCTAACCCTTTGCATTCACAAAACAATTAATA
ATTCACCAATAAATCATGTAAGTGTTTGTGACGCCAAATTGCCATACAAATACTTGTCAT
ATGAATATAAACGAATGAAACGATTGCCTATCCCATAGATGGCAACATTAAAAAGACCTC
TGAAGGTATCATCTTGATAACTTTAGAGGTCTTTGTTTATATTATTCAAACAAAATTCTT
ATAGAACGATCGAAGTATGTTTCGTCTTTCTTTTCTTCTTTAATCTGATCAGCTAATGCT
GGGTCATCTGTGATAATACCATCAACATTGGTTTGTAAGTATTTCGTTAAATCTTCTTCG
```

TABLE 7-continued

```
CCGTTAATAGTCCAAGTATAGACTTCTTTATTTTCCAAGTGCGCTTGATTAACAAGTCTT

GGCGAATAAGAAAAATCTTCGATGACAAAGAAATCTAATGATGTTTCTTTAAAATGACCA

AACTGCAACGGAATGATATAACCACACTTGAGATATGGCGCTTCTTTTTTCAACTTAGTC

ATCACATCATAATCCAAAGACATCACACGATATTGATGTTCAACACCATGCTTTTTCAAA

ATATCAATAACACGTTGTGTATAATCTGCTGGTTCTTTACCATGTGGCTTTAACTCTACT

AGTAGCTTCACATTTGATTGTTTAGCCGTTTCAATAAATTCGTCTAAGGATACAAATTTT

GCTTCATGTCCATTTTGACGCATTTTCAAACCGACGATATCTTTGAAATTAGATTCAGAA

ATATTTTTATTAACACCTGTTAAACGTTTCAAATTGTTATCATGACTAACAACAAATTGT

TTATCTTTCGTCATAATTGTATCTAACTCAACGTATTCGACATTCGCTTTTGCAGCAGCT

TTCAATGACGGAATAGAATTTTCAACACCTTTATCTTCGAAACCACGATGGCCAATAATG

GAGATATTTGTATTGATAGTATTATTGTAAAGTAAGTACATGTTATAACCGATAAAACAT

GTCACTGCAAGCACCATTGAAATTATAAAGAACCTAGACTTCCGTTTCGGTTTTGGATAT

TTAAATTCTAAGCCCGGTTGGTCTAATACATTCTCTTGTTTTAAGTGCAGTACTAACACA

CTGATTAATGATAATTTCGTAAATAAATAATAGAAGAACAATGCGCTTTTCAATACAACA

AATAAAATTGATGAGACTAAAAACTTATCTCCTTCTTCATCTACACAAATAGCAAGATAT

GTTGCTCCTGAAATAATTAATGTTAAAATCGCACCAATGATGAGTTCTAATATAACTATT

TCTATAACAAGCCGAAACTTATTTCGCTTCGTAATTTGCCAACTTAGTCTCATATTTTTA

AATAACGACTGGCGGTTTAAAATCGTTAACGGTAGAGTAAATATTAATTTAAAATTTAAT

ATAAATACAGCAATCATAAAGGTACCGTAAATGATTATACCTTTCGTCGTTTTCATAAGT

TCTTCCGTTAAAAATTTAGGTATGTAAATATTTTTTGTTAATACTGAACTTAGTCCTAGG

TTGGCAATGGGTATCATTAACATTAAATAAATGACAAAGAAAATAACTGGTACACCTATG

AGTTTACGCACATTTACAAAGGCATTTTTAAAAATGGATTTAAATGTAATAATCTGTCGA

TCAAAGCCGGCATAAACCATATAAACTAACAATGAAAACTCTACATAAATCAGAAAGGCA

ACACTTAATATGAATATAATAAGAAGTATCACACCTGGCGGATGACTAACGATTTCCGTC

CAATTGTTAATCGTAAGTTGGCTTTGCCCAGCTACTTTTAACATCATATTAAATAGTAAA

ATTAAGTATGTACTACTAATAAAAATCATGATTAACTGCAATAGTAAGGCATTAATGCTA

AAACGCCCTTTATTTTGATACAGTAATTTAAATACTGCCCATATATCTTTACTAATTCTC

TTCATAATCACGCTCCGCATTGCTTTAATATTAAGTTTCATCTTAATATTTTTCATTACT

CAGGGTCAATAAAAATTTGAAAAGACTCATATTCATATGCAAGTAGCAAATAATAACCCA

TTCAACATCAGCTAAATGATGATATTGGAACCCCACCTTTAACAAGACATCACATTCTTT

ATCAGCATAGCTACTTACAAAAACGTCTTCCTTCAACCATTGTAGAAGTTGTCTCATATA

CTTACTACGTCTTGCTAATACTCAATACTCAATTGAAAAAGAAGCATATGCCCCTTCACT

CTTGAAGTTGCATATGCTTTCTTTTCGGTCTGAATTGTATTTATAATTCAACGGGAATTT

TCCCTTTGAAGTTAACATAACGGTAGGCTGCTTTAACAGCTTCATCATCGGGCGCTTCGA

CATCTTCTAATTCATATGCAATGCCCAATGTTTTCCACTTATGAACACCTAACTGATGAT

ATGGCAGAATTTCAAACTTTTCGACGTTATCAAGAGAATTAATAAATTCCCCTAGTTTAA

TTAAATCGTCTTTATCATCAGAATAACCAGGCACAAGGACATGTCGAATCCATACAGGTT

GTTTCATATCTGACAGTTTGCGCGCGAAGTTAAGGATGTGTGTATTAGGCTTTCCTGTCA

ATCTAATATGTTGTCATTATCAATATGTTTTATATCTAATAATATCAAGTCTGTATGTT

TTTGTAATTCTTCAAAATGCCTTTGAAATGCTTTTGTATCATTAGCACATCCAGCCGATG
```

TABLE 7-continued

```
TGTCTAAGCAAGTGTGCACACCATTTTCTTTTAATTCTGCAAATAATTTTTCTAAGAATG
GCATTTGTAACAATGGTTCGCCACCACTGACTGTTACACCGCCACCCGATGCATCAAAGT
ATGGTTTGTATGGTAATATTTCATTCACCATTTCATCAACTGTGACTTCTCTTGATGGCT
CACTAATTTTCCAAGTATCTGGATTGTGGCAATACAAGCATCTAAGTAAGCATCCTTGTG
TAAATAATATATATCTTAATCCCGGTCCATCGACAGTACCTAAACTTTCGACAGAATGTA
AGTGTCCCTTAAGCATAGTGCTCCCACCTTAAATTTTGTTACATACTTTCATGGAATGTA
CGAGAAATTACATCTAATTGTTGTTCACGTGTTAATTTAATGAAGTTAACAGCGTAACCA
GATACACGGATTGTTAACTGTGGATATTCTTCTGGATGTTCCATTGCATCTATTAATGTT
TCACGGTTAAATACGTTAATATTTAAGTGGTGACCACATTGCATTGCGTAACCATCTAAC
ATACTAGTTAAGTTACGGTTTTGATCTTCTGGTTCTTTACCTAATGATTTTGGTACGATA
CTGAATGTATTTGAAATACCATCTTTACAGCAATCGTAAGGGATCTTAGCTACAGAACTT
AATGAAGATAATGCACCTTTTTGGTCACGGCCATGCATTGGGTTTGCACCTGGAGCAAAT
GGTTCGCCAGCTTTACGTCCGTCTGGTGTGTTACCAGTTTTCTTACCGTATACAACGTTT
GAAGTAATTGTTAATACACTCATTGTATGTTCTGAATCACGATATGTTTATGACTACGT
AATTTAGTCATGAAGCGTTCTACTAAATCAACTGCAATATCATCTACACGGTCGTCATTG
TTACCGTATTTAGGGAAGTCGCCTTCGATTTCAAAGTCTACTACAAGACCTTCTTCGTTA
CGAATTGGTTTAACTTGTGCATATTTAATTGCAGATAATGAGTCAGCTGCTACTGATAAA
CCAGCGATACCTGTTGCCATTGTACGTACAATTTCTGTATCATGTAATGCCATTTCAATA
CGTTCATAGCTGTATTTATCGTGCATGTAGTGAATAACATTTAATGAGTTAATGTAAACA
CCTGCTAGCCAATCCATCATTTGATCAAATTTCTTGAATACTTCGTCATATTCTAATACT
TCGCTGTTAATACCTTCGAAGTTTGGACCAACTTGTGCACCAGATTTTTCATCTTTACCA
CCATTGATAGCGTAAAGTAATGTTTTAGCTAAGTTCGCACGTGCACCGAAGAATTGCATT
TGTTTACCAATTGTCATCGCTGATACACAACATGCGATACCATAGTCATCGCCATAGCTT
TCACGCATAATGTCATCATTTTCATATTGGATAGAACTTGTTTTAATACTCATTTTTGCA
CAGTATGTTTTGAAGTTGTCAGGTA
LOCUS 21 (G3)
CTGAATAAAAACGCAACAAATAGTGCAAATGCTATCCCTGTGATAGCGAATAAAATATTC
ATGTATCATCACCTACAATAATTTATTAACAGCGACAGCAATTTTAGCACCCAACGCCGC
ATTGTTTTCAACAAGTTTTATATTTGCTGCTAAACTTTTACCATTCGTTTTTTCTACAAT
TTTCCCTAACAAGAACGGTGTGGCGTCCTTACCTTTAATACCTTGATTTTCCGCTTCAAC
AACAGCTTCATTTATGATTGCCTCAATATATGCTTTTGATAAGGCATGCTCATATGGAAT
TGGATTAGCAACAACAATGCCACCTTCAAGATTTAACTGCTGTTTTGTTAAATGAATGTC
AGCAAGTCGTTCTGGCGTTTCAACCGAACTTGTTAACTTAACACCGCTTTCGCGAGTGAA
GAATGCTGGCAATTCATTCGTTTGATATCCAATAACTGGAACGCCTTTTGTTTCTAAATA
CTCCATCGTCTTAGGTAAGTCTAAAATTGATTTGGCACCTGCACAGATAACAGTGACATT
TGTTTTAGACAGTTCTTCTAAGTCTGCTGAAATGTCCATCGTATGTTCTGCACCTTTAGT
GACGCCCCCAATACCTCCTGTAACAAAAAATTGAATACCAGCCATTGCAGCACATATCAT
CGTCGTCGCTACAGTAGTAGCAACCACACACTTCATCGCAATAACTTCTGCTAAATCCCT
TCTAGATACTTTAGCAACGTCTTTACTAGTTGCCAGTATTTCTAAATCTTCGCTTTCTAA
ACCAATTTTAATTTTGCCATCTATAATGGCTATGGTTGCTGGAATGGCACCATTATTCCT
```

TABLE 7-continued

```
GATAATTTGCTCTACTGTTGTTGCCATTTCAACATTTTGTGGGTACGGCATACCATGCGA

AATAATTGTTGATTCTAATGCTACAATCGGTTGATTGTTCTCCCGTGCTTGCTGAACTTC

TCGAGAATACTCAATATACTTTTGTAAATTTGCCATTTTTATAATCCTCCATATCGTGAT

AAAGTTGCTGTTGATCTAGGTTTTGCCTAACTGTATATTTCGTTTCTATCGTTTTCTTTG

CGTTAACCATACCAGCAATTAATATATCTTCAGTAGACATCCCATTTAACCAGCTATACA

CTACTGCAGCACAGAATGAATCGCCTGCACCTGTAACATCTTTCACACTATTTGATGGCA

TAACTGACTTAATGATTTCTTCCTCACCACTTCGATAAATGAGTTCTTTCACGCCATTTG

TCACAATAACATTTTTAACACCTAAATCATTCCAGCGTTTAGCAGCTATTTTTAAATCAT

CAGTAGATTCTATTTTTAAATTTAAGTATGTTTCTGTTTCATCTTTATTCGTGATAATCC

AATCAATAGCATGTAATGAATCAGGCATATTTTTCATTTTTGGGGAAGAAACCGTGGTGA

TAACTAATTTGATTTGATGTTTCGTGGTATAGGCACATAAGAAGTTTAATGCCTCTTTGC

CTAAATTCAAATCTACAATAATGCACTTAGCCTTTTTCAATAAGTGTGAACGCTTAATTA

AAAATTCAGGCGTAATGTAGTCAAACACTTCCATATCTGCTAAGCCATATGTCATGTCGC

CTTCTTTACTAATTAAAGCTGTATATGAACCTGTACTCGCATTTTCAAATTGTTGAACAT

GATCCAAA

LOCUS 22 (I19)
GATCCATTGGCCTTTTACCAATTGAAACATCGCCAGACAAAACACTTTCAATACCTAAAC

CACTTAACAAACCTGCCAATAATCGTGTTGTCGTACCAGAATTACCTGTATACAATACTT

GATGTGGCGTGTTAAAGATTGATATCCTGGGGAAGTCACAACTAATTTTTCATCATCTT

CTTTGATTTCTACACCTAACAGTCGGAAAATGTCCATCGTACGACGACAATCTTCGCCAA

GTAGTGGCTTATATATAGTAGATACACCTTCAGCTAGCGACGCCAACATGATTGCACGGT

GTGTCATTGACTTATCGCCCGGCACTTCTATTTCGCCCTTTAACGGACCTGAAATATCAA

TGATTTGTTCATTTACCATTTCATTCACCTACTTAAAATATGTTTTTAATTGTTCACATG

CATGTTGTAATGTTAGTTGATCAACATGTTGTACAACGATATCTCCAAATTGTCTAATCA

AGACCATTTGTACACCTTGCTTATCATTCTTTTTATCACTTAGCATATATTGGTATAACG

TTTCAAAATCCAAGTCAGTTATCATGTCTAAAGGATAGCCGAGTTGTATTAAATATTGAA

TATAATGATTAATATCATGCTTAGAATCAAACAAAGCATTCGCAACTATAAATTGATAGA

TAATGCCAACCATCACTGCATGACCATGAGGTATTTTATGATAGTATTCAACAGCATGAC

CAAATGTATGACCTAAATTTAAAAAATTTACGTACACCTGTTCTTTTTCATCTGCAATAA

CAATATCCAGCTTCGTTTCAATACCTTTAGCAATATATTTATCCATACCATTTAATGACT

GTAATATCTCTCTATCTTTAAAGTGCTGTTCGATATCTTGCGTCGCTGATTCACCATTCA

ATAACGCATGCTTATAAACTTCTGCATAGCCACTTAATATTTGCTCAAATGGTAACGTCT

TTAAAAAGACTAAATCATAAATCACAGCAGTTGGACGATAAAATGCACCGATAAGGTTTT

TACCTTGCTTTGAGTTAATACCCACTTTACCGCCAACACTAGAATCATGCGCTAGTATAG

TCGTTGGCACTTGTATAAAGTGCACGCCTCGTAAAAGTGTCGCCGCAATAAACCCAGCAA

AATCACCAGTTGCACCACCACCAACAGCAATAATTGCTGTATTACGAGTTACATGATGGG

ATAAAATATACTCTAATGTTTCTTGATATTGCTCAAATGTTTTCGTCTTTTCACCAGCTG

GAATAATAACTTTATGTACATTTTCATATGATAAAATATCATCAAATTTATCAGCAAAAT

ATTGATTTACATGCTCGTCAATTAATATAAAACTTTGATCAAACTGATCAATATACGTGC

TAATATGGTCAATTGCACCGTGTTCAACATATATTGGATAATTATTTGAAGGGTATGTTG
```

TABLE 7-continued

```
TTTGTAATTTCATGATTACACCTCAATTGTTCTTGTTGTTAAAACTCAATATTTAATTGT
CTGCGCTCAATAATTTGTTGTTTAAGTTGCTCAATATGATTTGATTGGAATTCTTCCAAT
AATGCTTTTGCTATTTCAAATGCTACGACATGTTCGCAGACGATACTTGCTGCAGGAACA
GCACAACTATCAGAACGTTCAATTGTTGCTTTAAAGTCTTCTTTAGTATTAATGTCTACT
GAATTTAATGGTTTATATAACGTTGGAATTGGTTTCATTACACCATTAACGATAATTGGC
ATTCCATTTGACATACCGCCTTCTAAACCACCTAAGTGATTAGATCCACGATAATAACCA
ATTTCACTATTATATAGAATTTCATCTTGAATCTCACTACCTGGCTTTTCAGCTGCTTTA
AATCCTTCACCAAAGCTTACACCTTTAAAAGCATTTATGCTGACAACACCTTGTGCAATC
TTACCATCTAACTTACGATCATAATGCACATAACTACCTACACCAACAGGCATATTTTCA
ACTACAACTTGAACGACACCGCCAATTGAATCTCCTTCATTTTTAGCTTCGTCAATTTTA
TCTCGCATTGCTTGTGCGATACTGTCATCAATTACACGAACATCATTACGATCAAGATTT
GCTTTAAATGTTTCTGAATCATAAAAATCTT
```

LOCUS 24(L10)
```
GATCGACCAATTCAAGTGGGCTCACATTTTCATTTTTATGAAGCAAATGCAGCATTAGAT
TTCGAACGTGAAATGGCATATGGAAAACATTTAGATATTCCAGCTGGAGCAGCTGTTCGA
TTTGAACCTGGGGATAAAAAAGAAGTTCAATTAGTTGAATATGCTGGCAAACGTAAAATT
TTTGGTTTTCGTGGTATGGTCAATGGTCCTATCGATGAGTCACGTGTCTATCGCCCAACT
GATGAAAATGATGAATATGCAGGTGTATTCGGAGATAACGGTGCTGAAAACGTGAATAAA
AAAGGAGGAAAAGATCATGAGCTTTAAAATGACGCAAAATCAATATACGAGCTTATACG
GTCCAACTGTTGGAGATTCCATTCGTTTAGGTGATACGAATCTATTTGCTCAAATAGAAA
AAGACTATGCGGTTTATGGTGAAGAAGCTACTTTTGGTGGTGGTAAATCTATTAGAGACG
GTATGGCGCAAAATCCTCGTGTAACACGTGATGACGTGAACGTTGCAGACCTTGTCATTT
CTAATGCCGTTATTATCGATTACGATAAAGTGGTTAAAGCTGATATAGGCATTAAAAATG
GTTATATTTTCGCCATAGGTAATGCCGGCAACCCAGATATAATGGATAATGTCGACATTA
TTATAGGTTCAACAACAGATATCATTGCCGCTGAAGGTAAAATCGTCACTGCTGGTGGTA
TTGATACTCATGTTCATTTTATTAATCCTGAACAAGCAGAGGTCGCATTAGAAAGTGGTA
TTACGACTCATATTGGTGGTGGTACTGGTGCTTCAGAAGGTTCTAAAGCAACAACTGTAA
CTCCAGGTCCATGGCATATTCATAGAATGTTAGAAGCTGCCGAAGGTTTACCGATTAATG
TCGGTTTTACAGGTAAAGGACAAGCAACAAATCCAACTGCACTCATTGAACAAATCAATG
CCGGAGCAATTGGATTAAAAGTACATGAAGACTGGGGTGCAACACCATCTGCTTTGAGTC
ATGCATTAGATGTTGCTGATGAATTTGATGTTCAAATTGCATTACATGCAGATACTTTAA
ATGAAGCAGGATTTATGGAAGACACAATGGCTGCTGTTAAAGACCGTGTACTTCATATGT
ACCATACTGAAGGTGCTGGTGGCGGTCATGCGCCTGATTTAATTAAATCCGCTGCATTTT
CAAATATTTTACCTTCATCTACAAATCCAACTTTGCCTTATACACATACTACTGTAGATG
AACATTTAGATATGGTAATGATTACTCACCATTTAAATGCGGCTATTCCTGAAGATATCG
CATTCGCAGATTCACGTATTCGTAAAGAAACGATTGCAGCAGAAGATGTTCTGCAAGATA
TGGGTGTATTCAGTATGATTAGTTCCGATTCACAAGCAATGGGCCGTGTAGGTGAAGTAA
TTACACGAACATGGCAAGTAGCACATCGCATGAAAGAACAACGTGGTCCTTTAGATGGTG
ATTTTGAACATAATGATAATAATCGCATCAAACGTTATATCGCTAAATATACAATTAACC
CAGCAATTACACATGGTATTTCTGAATATGTAGGATCTATCGAGCCGGGCAA
```

TABLE 7-continued

```
LOCUS 25 (HA4)
GATCAGCATGCTACGGTGAATACGTTCCCGGGTCTTGTACACACCGCCCGTCACACCACG

AGAGTTTGTAACACCCGAAGCCGGTGGAGTAACCTTTTAGGAGCTAGCCGTCGAAGGTGG

GACAAATGATTGGGGTGAAGTCGTAACAAGGTAGCCGTATCGGAAGGTGCGGCTGGATCA

CCTCCTTTCTAAGGATATATTCGGAACATCTTCTTCAGAAGATGCGGAATAACGTGACAT

ATTGTATTCAGTTTTGAATGTTTATTTAACATTCAAATATTTTTGGTTAAAGTGATATT

GCTTATGCGAGCGCTTGACAATCTATTCTTTTAAAGAAAGCGGTTGTTAGACAATGCAT

TAAGAAAAATTAAAGCGGAGTTTACTTTTGTAAATGAGCATTTGATTTTTTGAAAATAAA

GCAGTATGCGAGCGCTTGACTAAAAAGAAATTGTACATTGAAAACTAGATAAGTAAGTAA

AATATAGATTTTACCAAGCAAAACCGAGTGAATAAAGAGTTTTAAATAAGCTTGAATTCA

TAAGAAATAATCGCTAGTGTTCGAAAGAACACTCACAAGATTAATAACGCGTTTAAATCT

TTTTATAAAAGAAAACGTTTAGCAGACAATGAGTTAAATTATTTTAAAGCAGAGTTTACT

TATGTAAATGAGCATTTAAAATAATGAAAACGAAGCCGTATGTGAGCGTTTGACTTATAA

AAATGGTGGAAACATAGATTAAGTTATTAAGGGCGCACGGTGGATGCCTTGGCACTAGAA

GCCGATGAAGGACGTTACTAACGACGATATGCTTTGGGGAGCTGTAAGTAAGCTTTGATC

CAGAGATTTCCGAATGGGGAAACCCAGCATGAGTTATGTCATGTTATCGATATGTAATA

CATAGCATATCAGAAGGCACACCCGGAGAACTGAAACATCTTAGTACCCGGAGGAAGAGA

AAGAAAATTCGATTCCCTTAGTAGCGGCGAGCGAAACGGGAAGAGCCCAAACCAACAAGC

TTGCTTGTTGGGGTTGTAGGACACTCTATACGGAGTTACAAAGGACGACATTAGACGAAT

CATCTGGAAAGATGAATCAAAGAAGGTAATAATCCTGTAGTCGAAAATGTTGTCTCTCTT

GAGTGGATCCTGAGTACGACGGAGCACGTGAAATTCCGTCGGAATCTGGGAGGACCATCT

CCTAAGGCTAAATACTTTCTAGTGACCGATAGTGAACCACCACCGGGAGGGAAAGGGGAA

AAGCCCCCCGGGAGGGGAGGGAAATAAAACCTGAAACCGGGTGCTTACAAGTAGTCAAAA

CCCCTTTATGGGTGATGGCGCGCCTTTTGTAAAAAGAACCCGGGAGCTACCATTTGATGG

CAGGGTAAACAATACATGTGGAGCCCTACCGAAAGGCACCCTGAATAGGGGGTTTATTAT

TTGGGCCGCGACCCCCAAACCCGTTGTGCTCCCCTTGGGCCCGCTGTGACTTTTTGCCAC

TCCTCTGTGTGGGAGCGTCCCCCCGTCACCCCCGGGCCGCCCGGCGCAGCCCCGCCGGGC

GCCCCGACCACCCCATAACTAGCTGANNNNNNNNNNNTCAGCTAGTTATTTGTTTTAGCCT

TGCTGGCCTGCAGGTCGGACTCTAAAGCACCCCAAAGCTACCCGGGGAAACAGGCTTATC

TCCCCCAAAATTCACATCGACGGGGAGGTTTGGCACCTCGATGTCGGCTCATCGCATCCT

GGGGCTGTAGTCGGTCCCAAGGGTTGGGCTGTTCGCCCATTAAAGCGGGACGCGAGCTGG

GTTCAAAACGTGGTGAGACAGTTCGGTCCCTATCCGTCGTGGGCGTAGGAAATTTGAGAG

GAGCTGTCCTTAGTACGAGAGGACCGGGATGGACATACCTCTGGTGTACCAGTTGTCGTG

CCAACGGCATAGCTGGGTAGCTATGTGTGGACGGGATAAGTGCTGAAAGCATCTAAGCAT

GAAGCCCCCCTCAAGATGAGATTTCCCAACTTCGGTTATAAGATCCCTCAAAGATGATGA

GGTTAATAGGTTCGAGGTGGAAGCATGGTGACATGTGGAGCTGACGAATACTAATCGATC

GAAGACTTAATCAAAATAAATGTTTTGCGAAGCAAAATCACTTTTACTTACTATCTAGTT

TTGAATGTATAAATTACATTCATATGTCTGGTGACTATAGCAAGGAGGTCACACCTGTTC

CCATGCCGAACACAGAAGTTAAGCTCCTTAGCGTCGATGGTAGTCGAACTTACGTTCCGC

TAGAGTAGAACGTTGCCAGGCAGTTTTAAATCGGAGAATTAGCTCAGCTGGGAGAGCATC
```

TABLE 7-continued

```
TGCCTTACAAGCAGAGGGTCGGCGGTTCGAACCCGTCATTCTCCACCATTTATTCTTACA
TATTGCCGGCCTAGCTCAATTGGTAGAGCAACTGACTTGTAATCAGTAGGTTGGGGGTTC
AAGTCCTCTGGCCGGCACCATGGAAGAGCCATTAGCTCAGTTGGTAGAGCATCTGACTTT
TAATCAGAGGGTCAGAGGTTCGAATCCTCTATGGCTCACCATTTGCGGGTGTGGCGGAAT
TGGCAGACGCACTAGACTTAGGATCTAGCGCCTTACGGCGTGGGGGTTCGACTCCCTTCA
CCCGCATATGCAGAAGTAGTTCAGCGGTAGAATACAACCTTGCCAAGGTTGGGGTCGCGG
GTTCGAATCCCGTCTTCTGCTCCATTTTTATAGTGCCGGGGTGGCGGAACTGGCAGACGC
ACAGGACTTAAAATCCTGCGGTGAGTGATCACCGTACCGGTTCGATTCCGGTCCTCGGCA
CCATTTTCAATAAAAACATATGCGCCCGTAGCTCAATTGGATAGAGCGTTTGACTACGGA
TCAAGAGGTTATGGGTTCGACTCCTATCGGGCGCGTTAATTATACGGGAAGTAGCTCAGC
TTGGTAGAGCACTTGGTTTGGGACCAAGGGGTCGCAGGTTCGAATCCTGTCTTCCCGATA
TACTGTAATTATTATGGGGGCTTAGCTCAGCTGGGAGAGCGCCTGCTTTGCACGCAGGAG
GTCAGCGGTTCGATCCCGCTAGTCTCCACCATATTATTTACAAACTATATAAGGCGGTGT
AGCTCAGCTGGCTAGAGCGTACGGTTCATACCCGTGAGGTCGGGGGTTCGATCCCCTCCA
CCGCCACTATTTATTAGTTGTAAAATTATATTTAGGACCTTTAGCTCAGTTGGTTAGAGC
TAACGGCTCATAACCGTTCGGTCGCAGGTTCGAGTCCTGCAAGGTCCATATAATTTTGGA
GGAATACCCAAGTCCGGCTGAAGGGATCGGTCTTGAAAACCGACAGGGGCTTAACGGCTC
GCGGGGGTTCGAATCCCTCTTCCTCCGTTTTACTAATGGTCTCGTAGTGTAGCGGTTAAC
ACGCCTGCCTGTCACGCAGGAGATCGCGGGTTCGATTCCCGTCGAGACCGCCATTTAATT
TTATAATTAATAGCGATTTACCTATAATAATGGAGGAATACCCAAGTCCGGCTGAAGGGA
TCGGTCTTGAAAACCGACAGGGCCTTAACGGGCCGCGGGGGTTCGAATCCCTCTTCCTCC
GCCATTATTTTTTATTATCGCGGGATGGAGCAGTTCGGTAGCTCGTCGGGCTCATAACCC
GAAGGTCGGTGGTTCAAATCCGCCTCCCGCAATATTTTATAGGTCTCGTAGTGTAGCGGT
TAACACGCCTGCCTGTCACGCAGGAGATCGCGGGTTCGATTCCCGTCGAGACCGCCATCA
TTACATTTTTATTATGGTTCAGTAGCTCAGTTGGTAGAGCAATGGATTGAAGCTCCATGT
GTCGGCAGTTCGACTCTGTCCTGAACCATTTCTTAGCCGGCCTAGCTCAATTGGTAGAGC
AACTGACTTGTAATCAGTAGGTTGGGGGTTCAAGTCCTCTGGCCGGCACCATTTATGGAG
GGGTAGCGAAGTGGCTAAACGCGGCGGACTGTAAATCCGCTCCTTCGGGTTCGGCAGTTC
GAATCTGCCCCCCTCCATTTATTATTTTTAATAGGGGCATAGTTCAACGGTAGAATAGAG
GTCTCCAAAACCTTTGGTGTGGGTTCGATTCCTACTGCCCCTGCCATGCGGCTGTGGTG
AAGTGGTTAACACATCGGATTGTGGTTCCGACATTCGAGGGTTCGATCCCCTTCAGCCGC
CCTTATTATTAATGGGCTATAGCCAAGCGGTAAGGCAACGGACTTTGACTCCGTCACTCG
TTGGTTCGAATCCAGCTAGCCCAGTTATTGGCGGCATAGCCAAGTGGTAAGGCAGAGGTC
TGCAAAACCTTTATCACCGGTTCAAATCCGGTTGCCGCCTCCAGGTTTATGCGGGAGTAG
TTCAACTTTTAGAACACGTTCCTTCCCGGAACGAGGTATAGGTGCAAATCCTATCTTCCG
CTCCATAATTTAATAATAATGCGGGAGTATTTCAACTCTTAGAATACATTCCTTCCTGGA
ATGAGGTATAGGTGTAAATCCTATCTTCCGCTCCATAATTTAATATTTGCGGGAGTAGTT
CAACTTTTAGAACACGTTCCTTCCCGGAACGAGGTATAGGTGTAAATCCTATCTTCCGCT
CCATAATTGCTTCCAAAGGGAAGTTTTTTGTTTACCATTAAGCCGGTGTGGCGGAATTGG
CAGACGCGCGGGACTCAAAATCCCGTTCCACTTGTGGAGTGTCGGTTCGACCCCGACCAC
```

TABLE 7-continued

```
CGGTATAATTAACTGTTATTTACATAACATAACGTATTAGAAACCTTGTAAAACAAGGTT

TCTTTTTATTTCTCTCTATACAATACAAATAAAAGTGGACTCAAATGGCACACGCTTTAA

TAGACTGTATGTCAAATTGTAATGATGAGTTCAATATTGGAAGTTAAGCAACTATGCATT

GTTTAACGGTTCTCCACCAAATGTGGTGGGTATATAATTTAAAGAACTATTTTTAAAATA

CAACTTTTAGAGTTTTTATTATTAGGCGGCCAGTCCATTATTGGGCTTGGTTGTCTTCTT

TTTTTCTCCTTTGTACAAGCTGAAAATCATCATTATACGTGCTTTAAAGTTGTTGAAATT

TCTGTAACCAAAAGAAATTCACTTGATTAATTTTATCTTATTATTAATTCCTTCTATAGC

ACCATTATTAAATGCTGGGTAATAAATTGTATTTCTTAACATCCTTTGATGTTTTCTATA

ATATTTAACCACTTTCCATACACCCTTACTCACAGACTTTTTACTAACTGAATTTAAACG

ATTAATAAATTTAGGCCAATTACATAACCTTAGGTCTTTTCGTAATCCTTGGACAAGTTC

GTAGGAGTGTCGTAGTATATCGTCTTTTGAAAGCATGAATTCTACAATGTCAGATGAGCG

TTTATAAGCCTTAAAAGATTTATTCCATCTGTATTTACTAAAGATGGTTTTACTAGTATC

CATCAATAGGACTTTCCAGTTATTCTTAAAAATTGAATAATCAGGTCCTTTTTTATTACG

GTATTCATTCATAACTTGGACACGATACTTATTAAGGTCCTCTATTTAAATGTTGAACGA

TATGGAATCCGCTAACTAGCTGANNNNNNNNNNNTCAGCTAGTTACTCTCCCCAATAATCA

TCCTTGAGGGAGCCCTAAAGCTATTTGGAGAGACCCAGCATCTCAGGTTCGATTGGATTT

CTCCCTCCCCTCAGTTCATCCGCTCACTTTTCAACGTAAGTCGGTTCGGTCCCCCATTCA

GTGTTACCTGAACTTCAACCTGCCCAAGGGTAGATCCCCTGGTTTCGGGTGTACGACCAA

ATAATAAACGCCCTATTCAGACTCGCTTTCGTTACGGCTCCACATTTACTGCTTAACCTT

GCATCAAATCGTAACTCGCCGGTTCATTCTACAAAAGGCACGCCATCACCCATTAACGGG

CTCTGACTACTTGTAAGCACACGGTTTCAGGTTCTATTTCACTCCCCTTCCGGGGTGCTT

TTCACCTTTCCCTCACGGTACTGGTTCACTATCGGTCACTAGAGAGTATTTAGCCTTAGG

AGATGGTCCTCCCAGATTCCGACGGAATTTCACGTGCTCCGTCGTACTCAGGATCCACTC

AAGAGAGACAACATTTTCGACTACAGGATTATTACCTTCTTTGATTCATCTTTCCAGATG

ATTCGTCTAATGTCGTCCTTTGTAACTCCGTATAGAGTGTCCTACAACCCCAACAAGCAA

GCTTGTTGGTTTGGGCTCTTCCCGTTTCGGTCGCCGCTACTAAGGGAATCGAATTTTCTT

TCTCTTCCTCCGGGTACTAAGATGTTTCAGTTCTCCGGGTGTGCCTTCTGATATGCTATG

TATTCACATATCGATAACATGACATAACTCATGCTGGGTTTCCCCATTCGGAAATCTCTG

G

LOCUS 26 (L19):
GATCGCTAGTACTTCTTCAGGTGATGAAGCATGTAATAATTTCTCACGTACATTTTCATC

CATTAAAATACCAGACAACTTAGCTAAAGCATCTAGATGTGTTTGGGCGCCACCTTCTGG

CGCTGCAATCATAAAGAATAAGTGTGCTGGTTGCATATCCAAACTTTGATAATCTACGCC

TGCTTTAGATTTACCAAACGCAATAGCTGGTGACTTAACTGCGGCCACTTTGGCATGTGG

AATGGCAATACCTTCGCCGATACCAGTTGTACTTTGTGATTCTCGATTGTGAATCGCTTC

CTTAAATGACGCGACATCACTTAATTTACCTGCTTTGTCTAATTGATTTACTAACTCATC

AATAACACCATTTTTGTCATf1GCCATTAAATCCATTGCTATTGTATCTTTTGTTAATAA

CTCTGTTACTCTCATTATTTTCACTCCCCATCAAGTACGCTAATCGTAACTTGTGATTTT

ATTTTTTCTATAGCGTCCCGTGTTGCTAAGTCCTCATCAAATGCCGTGGCAGTACCGCAT

GCGACTGCTTGTTGGAATGCTTTTTCAATCGTTAAACCTGAAGCAATTCCAGCCACCATG
```

TABLE 7-continued

```
CCTGCAACTGTACTATCACCAGAGCCAACTGTATTAACCACTTTCCCTTGTGGATTAACT
GCTTTAATACTGATTTCTTTATCAATATAAATAGCACCATCACCGCCAAGCGAGACAATA
ACAGATTGCGCACCTTTATCAACTAACAAACGACCATATTTAATAACATCTGTGTCTGAG
TTCACTGTTGTATTAAACATCACTTCTAATTCATCTTTATTAGGTTTAATAAATAGTGGA
TGATATGGTAAAACGCTTTCAGCCAATTCTTTTTCAGCGTCGACTACTAATTTAGCACGT
GTCTGTGCTGTAATTTGTGCAATTTGCGCATACGCATCGCTTGGAATACTACTTGGTACA
CTTCCAGCAACAATAACTATATCTTCGCTTGTTGTATTTTTAATTTGTTGTAACAGTTGT
TCAAATTGTGTTGACGTTATATGAGGACCCGGTGCATTGATTTCTGTTTCTTGTCCTGTT
TTTAATTTCACATTAATACGTGTATCTTCATCAACTTCAATAAAATTCGATTGAATTGCA
CTGTTATTTAATGTATCTATAATGAATTTCCCAGGAAATCCACCTGCAAATCCCAAGGCA
GTTGACTCAACATCCAATGTCTTTAAGACGCGCGAGACATTAATACCTTTCCCCCCAGCG
AATTTATATGTTGCTGTTGCTCTGTTCAAACCATCAATTTTAAAATCATTCGTAAAAATG
ACATAGTCAATTGAAGGATTGAAAGTCACTGTATAAATCATAAAGTCCCTCCTATAAAGT
GATACTTTTGTTGGTATTCTTTTAACGATTCTTGATTTAATGCTTTTTCAGATGTGATGA
TTGTCGTACTTTCTAGCAAAGGTACACGAGCAAAATATACTTTATTAAACTTAGAATGAT
CTATAAGTACAAATGATTGATTGGCTAATGACATTGCTGTTTGTTTAACTAATGCCTCTT
GCTCATCGGGAGTAGTTAATCCAAGTTCAATATCTAATCCATTCATCCCGATAAAAGCTT
TATCGAAACAATATCGTCTTAATATCTCCATAGCACTAGAACCAATCGTAGCAAGTGTAT
TTTCTTTAACTTGACCACCTAGCATAATTGTTTTAATACCTTTTTTAAGTAAAGCTTCTA
CATGTGTTAAACCATTGGTTACCACAATGATATCTTTCGCTTGAATATATTTAATTAGCT
CCAATGTAGATGAACCAGCATCGATAAATAAGCATTCATTATCGTTGATTTGATTAGCTG
CTATTTTAGCAATCATTTTCTTTTCATCAAGATTCGTTGCTAATTTTTCAGTTAAATTCG
CCTCAACCATACGATTTTCTTTTAACATTGCACCACCATGCACACGTTGCAATTTCCCTA
ATTGTTGTAGTTTAGATAAATCTCTTCGTATTGTTGAAGCACTGCAACCAGTTCGATC
LOCUS 27A (A2)
GGATCTCCTGTATTGAATTCTAAACATGAACTGATTGGTATTTTATATGCAGGTAGTGGA
AAAGATGAATCTGAAAAGAATTTCGGTGTTTATTTCACACCACAATTAAAAGAATTTATT
CAAAATAATATTGAAAAATAAGTATCATCAATTCATTCGTGAAGTTGATTTTTTAAAGAG
TGATTAAGAAAACGGTTACATAATTAACTAAATATACTGAATTATGTATCTAGATATCAA
AATAATTAAAAGAGAGGAACTTAAAATGAACAAAAACGTAGTCATCAAGAGTTTAGCAGC
ATTAACAATTTTAACATCTGTAACAGGTATTGGAACAACATTGGTTGAGGAAGTACAACA
AACTGCCAAAGCAGAAAATAATGTCACAAAAGTTAAAGATACTAATATTTTTCCATATAC
LOCUS 27B (A5)
GAAAAATAAGTATCATCAATTCATTCGTGAAGTTGATTTTTTAAAGAGTGATTAAGAAAA
CGGTTACATAATTAACTAAATATACTGAATTATGTATCTAGATATCAAAATAATTAAAAG
AGAGGAACTTAAAATGAACAAAAACGTAGTCATCAAGAGTTTAGCAGCATTAACAATTTT
AACATCTGTAACAGGTATTGGAACAACATTGGTTGAGGAAGTACAACAAACTGCCAAAGC
AGAAAATAATGTCACAAAAGTTAAAGATACTAATATTTTTCCATATACTGGTGTAGTTGC
TTTTAAAAGTGCAACTGGATTTGTAGTTGGAAAGAATACTATTTTAACAAATAAACATGT
GTCGAAAAATTACAAAGTGGGCGATCGTATTACTGCACATCCAAATAGTGATAAAGGTAA
TGGTGGTATTTATTCGATTAAAAAGATTATTAATTATCCAGGTAAAGAAGATGTATCAGT
```

TABLE 7-continued

```
CATTCAAGTTGAAGAGCGTGCAATAGAACGTGGACCAAAAGGCTTTAATTTTAATGATAA
TGTAACGCCATTCAAATATGCGGCAGGGGCTAAAGCTGGTGAGCGAATTAAAGTGATTGG
TTATCCACACCCATACAAAAATAAATATGTTTTATATGAGTCAACTGGCCCTGTGATGTC
AGTAGAAGGTAGCAGTATTGTATATTCAGCGCATACTGAAAGCGGAAACTCTGGATCACC
TGTATTAAACAGCAACAACGAATTAGTTGGTATTCATTTTGCTTCTGATGTAAAAAATGA
TGATAACAGAAATGCATATGGCGTCTACTTTACACCAGAAATTAAAAAATTCATTGCAGA
AAACATAGATAAATAAACAAATTGACTTTAAACGAGCGTTGCAACATATCTCGAATTGTA
AAGGAGCTTGAAAATGAATAAAAATATAGTCATTAAAAGCATGGCAGCATTAGCCATTCT
AACCTCAGTAACTGGAATAAATGCTGCAGTCGTTGAAGAGACACAACAAATAGCAAATGC
AGAGAAGAATGTTACGCAAGTTAAAGATACAAATATTTTTCCATATAATGGCGTCGTTTC
ATTTAAAGATGCGACAGGTTTTGTAATTGGAAAAAATACAATTATCACCAATAAACATGT
ATCAAAAGATTATAAAGTTGGCGATAGAATTACTGCCCATCCAAACGGTGACAAAGGAAA
TGGTGGTATATATAAAATTAAAAGCATTTCTGATTATCCGGGTGATGAAGACATCTCTGT
CATGAATATTGAAGAACAAGCAGTCGAACGTGGACCAAAAGGCTTTAATTTTAATGAAAA
TGTCCAAGCATTCAATTTTGCGAAAGATGCTAAAGTTGATGACAAAATTAAAGTTATTGG
TTACCCATTACCTGCTCAAAATAGTTTTAAACAGTTTGAATCTACAGGAACTATAAAAAG
AATCAAAGACAATATTTTAAATTTTGATGCATACATTGAACCCGGGAATTCAGGATCACC
AGTTCTAAATTCTAACAATGAGGTCATAGGTGTGGTGTATGGCGGTATTGGAAAAATTGG
TTCTGAATATAATGGTGCCGTATACTTTACGCCTCAAATCAAAGATTTTATTCAAAAGCA
CATTGAACAATAAACAAATTTAAATATACACCATGAGCATGTGTTCAATAATTTTAATGA
AAAACATCGGTCGAATATAACATAAAAAAACGTCTATATCAAAAGCATCATGAATAAACA
GAGGAGCACAAAAATGAATAAAAATATAATCATCAAAAGTATTGCGGCATTGACGATTTT
AACATCAATAACTGGTGTCGGCACAACAGTGGTTGATGGTATTCAACAAACAGCCAAAGC
AGAAAATAGTGTGAAATTAATTACCAACACGAATGTTGCACCATACAGTGGTGTTACATG
GATGGGCGCTGGAACAGGATTTGTAGTTGGGAATCATACAATCATTACCAATAAACATGT
TACTTATCACATGAAAGTCGGTGATGAAATCAAAGCACATCCTAATGGTTTTTATAATAA
CGGTGGTGGACTTTATAAAGTTACTAAGATTGTAGATTATCCTGGTAAAGAAGATATTGC
GGTCGTACAAGTTGAAGAAAAATCAACGCAACCAAAAGGTAGAAAATTCAAAGATTTCAC
TAGCAAATTTAATATAGCATCAGAAGCTAAAGAAAATGAACCTATATCAGTCATTGGTTA
TCCAAATCCTAATGGAAATAAACTACAAATGTATGAATCAACTGGTAAAGTACTATCAGT
GAATGGAAATATAGTGACATCTGATGCGGTTGTCCAACCTGGCAGCTCTGGTTCACCTAT
ATTAAATAGTAAGCGAGAAGCAATTGGTGTTATGTATGCTAGTGATAAACCAACAGGTGA
AAGTACAAGGTCATTTGCTGTTTATTTCTCTCCTGAAATTAAGAAATTTATTGCAGATAA
TTTAGATAAATAAATCATCCATCCATACATTGATAAATGATTTTTAGAAATTAACAACAA
AATCAACAATTTTAAACATCTCTGTGATTCTATTTATTCGAAATGATTTAAAAAATAAAA
CTTCAAAAACCTAACCTTATATTTATACGAATACTTAGAGGAGCACAAAAATGAATAAAA
ATATAATCATCAAAAGTATTGCAGCATTGACGATTTTAACATCAGTGACTGGCGTCGGCA
CAACAGTGGTTGAGGGTATTCAACAAACGGCTAAAGCTGAACATAATGTGAAACTAATCA
AAAATACTAATGTAGCACCATACAATGGTGTCGTTTCGATAGGATC
```

TABLE 7-continued

```
LOCUS 27C (A7)
GGATCACCAGTTCTAAATTCTAACAATGAGGTCATAGGTGTGGTGTATGGCGGTATTGGA

AAAATTGCTTCTGAATATAATGGTGCCGTATACTTTACGCCTCAAATCAAAGATTTTATT

CAAAAGCACATTGAACAATAAACAAATTTAAATATACACCATGAGCATGTGTTCAATAAT

TTTAATGAAAAACATCGGTCGAATATAACATAAAAAAACGTCTATATCAAAAGCATCATG

AATAAACAGAGGAGCACAAAAATGAATAAAAATATAATCATCAAAAGTATTGCGGCATTG

ACGATTTTAACATCAATAACTGGTGTCGGCACAACAGTGGTTGATGGTATTCAACAAACA

GCCAAAGCAGAAAATAGTGTGAAATTAATTACCAACACGAATGTTCCACCATACACTGGT

GTTACATGGATGGGCGCTGGAACAGGATTTGTAGTTGGGAATCATACAATCATTACCAAT

AAACATGTTACTTATCACATGAAAGTCGGTGATGAAATCAAAGCACATCCTAATGGTTTT

TATAATAACGGTGGTGGACTTTATAAAGTTACTAAGATTGTAGATTATCCTGGTAAAGAA

GATATTGCGGTCGTACAAGTTGAAGAAAATCAACGCAACCAAAGGTAGAAAATTCAAA

GATTTCACTAGCAAATTTAATATAGCATCAGAAGCTAAAGAAAATGAACCTATATCAGTC

ATTGGTTATCCAAATCCTAATGGAAATAAACTACAAATGTATGAATCAACTGGTAAAGTA

CTATCAGTGAATGGAAATATAGTGACATCTGATGCGGTTGTCCAACCTGGCAGCTCTGGT

TCACCTATATTAAATAGTAAGCGAGAAGCAATTGGTGTTATGTATGCTAGTGATAAACCA

ACAGGTGAAAGTACAAGGTCATTTGCTGTTTATTTCTCTCCTGAAATTAAGAAATTTATT

GCAGATAATTTAGATAAATAAATCATCCATCCATACATTGATAAATGATTTTTAGAAATT

AACAACAAAATCAACAATTTTAAACATCTCTGTGATTCTATTTATTCGAAATGATTTAAA

AAATAAAACTTCAAAAACCTAACCTTATATTTATACGAATACTTAGAGGAGCACAAAAAT

GAATAAAAATATAATCATCAAAACTATTGCAGCATTGACGATTTTAACATCAGTGACTGG

CGTCGGCACAACAGTGGTTGAGGGTATTCAACAAACGGCTAAAGCTGAACATAATGTGAA

ACTAATCAAAAATACTAATGTAGCACCATACAATGGTCTCGTTTCGATAGGATCTGGAAC

AGGTTTCATTGTCGGTAAAAATACAATTGTTACCAACAAGCATGTCGTTGCAGGTATGGA

AATTGGTGCACATATTATAGCGCATCCCAATGGTGAATATAATAATGGCGGATTTTATAA

AGTTAAAAAAATTGTCCGTTATTCAGGTCAAGAAGATATTGCCATTCTACATGTGGAAGA

TAAAGCTGTTCATCCAAAAAACAGGAATTTTAAAGATTACACAGGCATTTTAAAAATAGC

ATCAGAAGCTAAAGAAAATGAACGCATTTCAATTGTTGGCTATCCAGAACCATATATAAA

TAAATTTCAAATGTATGAGTCAACAGGAAAAGTGCTGTCAGTTAAAGGCAACATGATTAT

TACTGATGCTTTCGTAGAACCAGGCAACTCAGGTTCAGCTGTATTTAACAGTAAATACGA

AGTTGTAGGTGTTCACTTTGGTGGAAACGGCCCTGGAAATAAAAGTACAAAAGGATATGG

TGTTTATTTCTCTCCTGAAATTAAGAAATTCATTGCAGATAACACAGATAAATAAATCCT

TACATAGATAAATGATTTTAAAAATTAACAACAAACTCAACAATTCAAATCATCTCTGTG

ATTCCATTTATTCGAAATGATTAAAAAAAATAAAACTTCAAAAAGCTAACATTATAATTA

TACAAATACTTAGAGGAGCAGAAAATGAATAAAAATATAATCATCAAAAGTATTGCAGC

ATTGACGATTTTAACATCAATAACTGGTGTCGGCACAACAATGGTTGAAGGTATTCAACA

AACAGCCAAAGCCGAAAATACTGTTAAACAAATTACAAATACAAATGTTGCACCATACAG

TGGTGTTACATGGATGGGCGCTGGAACAGGATTTGTAGTTGGAAATCATACAATCATTAC

CAATAAACATGTTACCTATCACATGAAAGTCGGTGATGAAATCAAAGCACATCCTAATGG

TTTTTATAATAACGGTGGTGGACTTTATAAAGTTACTAAGATTGTAGATTATCCTGGTAA
```

TABLE 7-continued

```
AGAAGATATTGCGGTTGTACAAGTTGAAGAAAAATCAACACAACCAAAAGGTAGAAAATT
CAAAGATTTCACTAGTAAATTTAATATAGCATCAGAAGCTAAAGAAAATGAACCTATATC
AGTCATTGGTTATCCAAATCCTAATGGAAATAAACTACAAATGTATGAATCAACTGGTAA
AGTATTATCAGTGAATGGGAATATAGTGTCATCGGATGCAATTATTCAGCCTGGTAGCTC
TGGTTCACCTATATTAAATAGTAAACACGAAGCTATTGGTGTAATCTATGCCGGTAATAA
GCCATCAGGTGAAAGCACAAGAGGATTTGCTGTTTATTTCTCTCCTGAAATTAAGAAATT
CATTGCAGATAATTTAGATAAATAATTAAAACTTAGACATTCACCCAATCCTGACAAAAT
ATACTATAACTAACATTTATTAATATATATTGCATTATTTAATATGCATCAAAGCCAATC
AACGATTGATTTTCACCAACTCAATTGTTGATTGGTTTTATTTATGTATGAATGAACAAC
TTTTTGACATCATTAAGAATATAAATGATTTTGAAAGCATTTGAAAGCTACAACATTTCT
ATAAAATTTTTCAATAACAATTGCGCCACTAAAACTCAAAATTTCCACCACCAACATCCA
AATTATCAACATCGCAACATAACCAAATGTTATAATAAATCTATTACACAAAGAGATAAA
TTACTTATGCAAAGGCGGAGGAATCACATGTCTATTACTGAAAAACAACGTCAGCAACAA
GCTGAATTACATAAAAAATTATGGTCGATTGCGAATGATTTAAGAGGGAACATGGATGCG
AGTGAATTCCGTAATTACATTTTAGGCTTGATTTTCTATCGCTTCTTATCTGAAAAAGCC
GAACAAGAATATGCAGATGCCTTGTCAGGTGAAGACATCACGTATCAAGAAGCATGGGCA
GATGAAGAATATCGTGAAGACTTAAAAGCAGAATTAATTGATC
LOCUS 27D (AF7)
GATCTGGAACAGGTTTCATTGTCGGTAAAAAT
ACAATTGTTACCAACAAGCATGTCGTTGCAGGTATGGAAATTGGTGCACATATTATAGCG
CATCCCAATGGTGAATATAATAATGGCGGATTTTATAAAGTTAAAAAAATTGTCCGTTAT
TCAGGTCAAGAAGATATTGCCATTCTACATGTGGAAGATAAAGCTGTTCATCCAAAAAAC
AGGAATTTTAAAGATTACACAGGCATTTTAAAAATAGCATCAGAAGCTAAAGAAAATGAA
CGCATTTCAATTGTTGGCTATCCAGAACCATATATAAATAAATTTCAAATGTATGAGTCA
ACAGGAAAAGTGCTGTCAGTTAAAGGCAACATGATTATTACTGATGCTTTCGTAGAACCA
GGCAACTCAGGTTCAGCTGTATTTAACAGTAAATACGAAGTTGTAGGTGTTCACTTTGGT
GGAAACGGCCCTGGAAATAAAAGTACAAAAGGATATGGTGTTTATTTCTCTCCTGAAATT
AAGAAATTCATTGCAGATAACACAGATAAATAAATCCTTACATAGATAAATGATTTTAAA
AATTAACAACAAACTCAACAATTCAAATCATCTCTGTGATTCCATTTATTCGAAATGATT
AAAAAAAATAAAACTTCAAAAAGCTAACATTATAATTATACAAATACTTAGAGGAGCAGA
AAAATGAATAAAAATATAATCATCAAAAGTATTGCAGCATTGACGATTTTAACATCAATA
ACTGGTGTCGGCACAACAATGGTTGAAGGTATTCAACAAACAGCCAAAGCCGAAAATACT
GTTAAACAAATTACAAATACAAATGTTGCACCATACAGTGGTGTTACATGGATGGGCGCT
GGAACAGGATTTGTAGTTGGAAATCATACAATCATTACCAATAAACATGTTACCTATCAC
ATGAAAGTCGGTGATGAAATCAAAGCACATCCTAATGGTTTTTATAATAACGGTGGTGGA
CTTTATAAAGTTACTAAGATTGTAGATTATCCTGGTAAAGAAGATATTGCGGTTGTACAA
GTTGAAGAAAATCAACACAACCAAAAGGTAGAAAATTCAAAGATTTCACTAGTAAATTT
AATATAGCATCAGAAGCTAAAGAAAATGAACCTATATCAGTCATTGGTTATCCAAATCCT
AATGGAAATAAACTACAAATGTATGAATCAACTGGTAAAGTATTATCAGTGAATGGGAAT
ATAGTGTCTTCGGATGCAATTATTCAGCCTGGTAGCTCTGGTTCACCTATATTAAATAGT
```

TABLE 7-continued

```
AAACACGAAGCTATTGGTGTAATCTATGCCGGTAATAAGCCATCAGGTGAAAGCACAAGA
GGATTTGCTGTTTATTTCTCTCCTGAAATTAAGAAATTCATTGCAGATAATTTAGATAAA
TAATTAAAACTTAGACATTCACCCAATCCTGACAAAATATACTATAACTAACATTTATTA
ATATATATTGCATTATTTAATATGCATCAAAGCCAATCAACGATTGATTTTCACCAACTC
AATTGTTGATTGGTTTTATTTATGTATGAATGAACACTTTTTGACATCATTAAGAATAT
AAATGATTTTGAAAGCATTTGAAAGCTACAACATTTCTATAAAATTTTTCAATAACAATT
GCGCCACTAAAACTCAAAATTTCCACCACCAACATCCAAATTATCAACATCGCAACATAA
CCAAATGTTATAATAAATCTATTACACAAAGAGATAAATTACTTATGCAAAGGCGGAGGA
ATCACATGTCTATTACTGAAAAACAACGTCAGCAACAAGCTGAATTACATAAAAAATTAT
GGTCGATTGCGAATGATTTAAGAGGGAACATGGATGCGAGTGAATTCCGTAATTACATTT
TAGGCTTGATTTTCTATCGCTTCTTATCTGAAAAAGCCGAACAAGAATATGCAGATGCCT
TGTCAGGTGAAGACATCACGTATCAAGAAGCATGGGCAGATGAAGAATATCGTGAAGACT
TAAAAGCAGAATTAATTGATC

LOCUS 28 (H130)
AAATATTCGACAACATCGTCTGGTAGACAGTCAGGACGCGTACCAATAGATAATCCCACA
ACACCCGGTTCTTTAAGTACAGGTTCGAATTTTTCTTTTAATACTTCAACCGGTGCATGT
GTATTTGTAAATGCCTGAAAATAAGCAATATATTTTCCTTCGTGCCATTTCTCATGCATC
TTTTCTTTAATTTCTTTAAATTGTACTGCGATTGAATCTGCACGATTACCTGCAAAGTCT
CCGCTACCTGCAGCAGAACAAAATGTACATCCACCATGTGCTACAGTGCCATGCGCCTTA
GGACAGTCAAACCCGCCATCCAATGCAACTTTAAATATTTTTTGTCCAAATTTATTTTTT
AAATGGTAATTCCATGTGTGATAACGTTTGTTTTCAAAAGCGTATTGGAAATGATTGCCC
ATATGTCATTTTCCTTTCTATAAAAAAAGAGTTCTAAGTACAGATTTTAACATATTTTAA
TGTTATAGTGTTTATTATAGTTTGACAAAAAAGAGAGAGGAACTATGAAATATGAATATA
CCTAAATCAGTCTGGTGGCTAGTAATTGGCATGGCGTTAAATATTACTGGTTCCAGTTTT
TTGTGGCCTTTAAATACAATTTATATGAAACAAGAACTTGGAAAAAGTTTAACTGTTGCT
GGTTTAGTGCTAATGATAAATTCATTTGGCATGGTTATTGGAAACTTATTAGGTGGTTCA
CTATTTGATAAATTAGGTGGATACAAGACGATTTTAATTGGAACTTTCACTTGTCTTTGT
AGTACAACGCTACTTAATTTCTTTCACGGGTGGCCTTGGTATGCTGTATGGCTTGTAATG
TTAGGGTTTGGTGGCGGAATGATTATTCCTGCGATATACGCTATGGCTGGAGCAGTGTGG
CCAAATGGCGGAAGACAAACGTTTAATGCGATATACTTAGCGCAAAATATTGGTGTGGCT
GTCGGTGCTGCAATGGGCGGCTTTGTCGCAGAATTTAGCTTTAACTATATCTTTTTAGCC
AATCTTATTATGTATGTTGTGTTTGCGCTTGTCGCGGTAACGCAATTTAATATTGAAATT
AATGCGAAAGTTAAATATCCAACTCATTTAGATATTACTGGTAAAAAGAATAAAGCAAGA
TTTATTTCATTAGTACTAATTTGTGCAATGTTTGCAATTTGTTGGGTTGCATATATTCAA
TGGGAGTCTACAATCGCTTCATTTACACAATCTATTAATATTTCAATGGCACAATATAGT
GTTTTATGGACAATTAACGGAATAATGATTTTAGTAGCACAACCATTAATTAAACCGATT
CTCTATCTGTTAAAAGGAAACTTAAAGAAGCAAATGTTTGTCGGCATCATCATTTTTATG
TTGTCGTTCTTTGTCACGAGTTTTGCCGAAAACTTTACAATATTTGTTGTCGGTATGATT
ATTTTAACTTTTGGAGAAATGTTTGTATGGCCAGCAGTTCCAACTATAGCCAATCAGTTA
GCGCCAGATGGTAAGCAAGGACAGTACCAAGGTTTTGTGAATTCAGCTGCTACAGTAGGA
```

TABLE 7-continued

AAAGCATTTGGTCCATTTCTTGGTGGTGTATTAGTTGATGCGTTTAATATGCGCATGATG

TTTATCGGTATGATGCTACTACTTGTATTTGCATTAATATTATTAATGGTTTTCAAGGAG

AATAATACGCAACCTAAAAAAATAGATGCATAATGAGTAAATAGAATTAACGTTATAGAC

TTGAAATAAATGTCGTTATAACATAATATTAATTTGTATAATTTAATTTCGTTTGGAGCT

TTTCTACAGAAAGCTAGTGATGCTGAGAGCTAGTGTTAAGGACTAAATGTAAATCGTATT

AATTTTAAATTGAATGAATGACATCTCTTACTATTAAAATGAGTGCACAATTTTTGTGAA

ATAGGGTGGTAACGCGGCAAATGTCGTCCCTATGTAAATAGAATAGTTAGAGGTGTCTTT

TTTATTGAATAGGAGGAAATGTGTTGAATTACAACCACAATCAAATTGAAAAGAAATGGC

AAGACTATTGGGACGAAAATAAAACATTTAAAACAAATGATAACTTAGGTCAAAAGAAAT

TTTATGCTTTAGACATGTTTCCATATCCATCAGGTGCTGGTTTACATGTTGGACATCCTG

AGGGCTATACAGCAACAGATATCATTTCAAGATATAAAAGAATGCAAGGATATAATGTAT

TACATCCGATGGGGTGGGATGCATTCGGATTACCAGCAGAGCAATATGCTTTAGACACTG

GCAACGACCCACGTGAATTTACAAAGAAAAATATCCAAACTTTTAAACGACAAATTAAAG

AATTAGGGTTCAGTTATGATTGGGATCGTGAAGTTAATACAACA

LOCUS 29 (A)N10
GATCTTGCTTGCGTTTTCTAAACAATAGTAATGATCCTAATAATGCCATCATTGCACCAA

ATAAAGTTGCATTTGTGTTTTCGCTCTTATCTCCTGTTTCTGGTAAAGCATCAGTTTTGT

GTTGTTTTGATACCTTATTAGAATGGTTTACTTCACCTTTAGGATTTGATGGTGCTTTCT

GTTCATTATTTGGTGGTGTAACTCTTGAATCGGAGTCACTATCTGAGTCTGAGTCGCTAT

CTGAATCCGAGTCGCTATCCGAGTCTGAGTCGCTATCTGAGTCTGAATCGCTGTCTGAGT

CTGAGTCGCTATCCGAGTCTGAGTCGCTGTCTGAATCTGAATCACTGTCTGAATCCGAAT

CGCTATCTGAATCTGAATCGCTATCCGAGTCTGAGTCGCTGTCTGAATCTGAATCGCTGT

CTGAGTCCGAATCGCTATCTGAATCTGAGTCGCTGTCTGAGTCTGAATCGCTATCTGAAT

CTGAGTCGCTATCTGAGTCTGAGTCGCTGTCTGAGTCTGAGTCGCTGTCTGAGTCTGAAT

CGCTATCTGAATCTGAGTCGCTGTCTGAGTCTGAGTCGCTATCTGAGTCTGAGTCGCTGT

CTGAATCTCAGTCGCTGTCTGAATCTGAATCGCTGTCTGAGTCTGAATCGCTATCTGAGT

CTGAATCGCTATCTGAGTCTGAATCACTGTCTGAGTCCGAGTCACTGTCTGAATCTGACT

CACTATCTGATTCTGAGTCGCTATCTGATTCTGAGTCGCTGTCTGAATCTGAATCACTGT

CTGAATCCGAATCGCTATCTGATTCTGAGTCGCTATCTCAACCTGAGTCGCTGTCTGAGC

CTGAGTCACTGTCTGAATCCGAATCCGGATCCGGGTCTGGGCTTGCTTCCGGTTCTGGGT

CTGGACTTGGTTCTGGATCTGGCGTTGGTTCTGGTTCTGGGTCTGGACTTGGTTCTGGGT

CAACCGGCGGCCCTGGAGTTGGGTCTTTCGGATTTACTGCTGAATCACCATCAGCACTTC

CACCACCATAACGTACAACATTCTCATTATTCCAACCGAAAATACTGTAGTCTCTATTTG

TTACAGGATCAACATTTTCTTGAATAACCTGAGTTTTTAACTTCTTACCTGTATTGTCGT

AATGCCCTTCTACTAATACTACATATGTTTTAGTAATATCACCAAATTTAATACTAGCTA

CATTTGGATGCTCATAATAGATTCTATTTTTAAATTGGTCTGTTACTTCTTTAAGGTTAG

AGTCATTTGGATCTGCATAGTAGCTATCTGATAATTTAGATGTATCATTCACTTCAAAAA

TTCTCAGTTTTGTATCTGTAGCACTTACTTTACCGCTACTTTCTTCGATTTTATCTTGGT

AGCCTTTAATATACACCCACGTATTACCTAAAACTCGTTGCTTAGGGTTAACAAATACTG

TTTGCTTGTATGTGTTTTGACCTGAAGCTGTATCTACACCAATAATTTGAGAAGAAATGT

TABLE 7-continued

```
TCGCGCCATTTGGTTTATCAATTCCTGCAATTGGCGAACTATAGTTATAAGTAATTTTAT

TATTAAACATTTCATCCGCAATATTAATATTCGCATCATATGTTCCTGATTTAGGTGCCT

TTGCTCGGTCTGTAAATAAAGGTAATGAAAATTGTCCGTTAATATTTTCTTTATTATTTA

CATAATCTGTAAAGACAAATGTATACGTCTTAGTCAAGATATCATATGTTGCTTTAGCTA

CAACATCGCCATTCGTACTTTTAATGTCTGCAATTGGCATCGTATTATTTGAATTAGAAT

AATCCACGTCTCCATTACCAGTTAAACTATCTGGTAACTTCGCTGTAAAATAATCCCCTG

ATTTCACTTTATCTGTCACTGTAAAATTTGCCGCCATAAATGTGTTACCACTTTGATTAG

GGTCAAATGTAGTCTTTTCTAACTTGAAATTACTTGCCGTAACTTTATCATTTACATTTG

TACCTTTAGCATCAGCAGCATTTACTACCGGTTCAGCAACAGCTAAACTACGTACAGCTC

TCGTTCTAACACTTGGTTTACTAGTTCCTTGCGCATTGGAAATCGTTTGTGGTGATGATT

GTGGTAAATCTAATGTTTGAGAATTTTTAAGCTCACTGTTTGTTGCTATGCTATTAGCAT

CATTCGTTGTTTTATTATCTACTTGAGAATTTGCTTCTTGAGGAACAGTTTGATCTTGCA

TTTTTGCAGCAGTTGCTTGATTTTTAATTGCCGTCGGTTGAGGTGTTTCATTTGTTGAAG

CTGGCTCTGTTGTAGTGGTATTGCTCGTTTGTGTAGACATTGGTTTTGTTGTGCTATCTA

CATTCGCACTGTTTGTGTTTGCACTAATATCAGATGTATCATTAGCCGTTGTATTTAATT

GAGGTGTTTCTATCATATTGTTTTTTTCGGAATCTGCACTTGCATTATTTTTCGAAGATT

GCGTTGTATCGTTCGATTGTTCTGAAGCTTGTGCTTGATGATTGCCTATCCCAAATAGTA

TAGTTGCCCCTACTATTACTGATGTGGTACCTACTGTAAAACGTCTAAJCGAATACTTAT

TCTGCTTATTCGACAAATAATCAATTCTTTTTTTCAAAAATATTACTCCATTTCAATTTC

TAGATTAGTCTAAATTGTATAATGAAATAAGAATTATATCAATTGCTTTTCGAAAAAAAT

TACGTAAAATTTGTTTTCTTCCTATTTATATAACTTAAAATTTTCTGTTAACTAGCAAAA

ATCAATATACTATTTTTACACTATTACAAATTTTTTACTTTTCAAAAACTTAGAAGTTCT

AAATTTTTCATCACCTTAAATTTTACTGTAATTTCAACAATCAAATTTAACTAACATTTT

AAATTATTCATCATGCTAGCAAAAAAGGCCTAACGTATAAATGTACGTTAGACCTCATGT

TCAACTTATTCATTTTACATTGTATATTAAACACATACATCATTGAATAAATGTTTGCTT

ACTAACC

LOCUS 29 (B)GE2
GATCCACATTGGGCATAATCACAGCTAATTTGTGTTCATTCGCATACCTTTCTATGCTTG

TATATCTCATATATGTCGTTTCATCACTTGATAATCCATGTAACAACATTAAAGTTTTTA

ATGGTTTAACAGTTGTATCGCTATTAAAGAAGCTTTGATCTTCCGGTAAAATGACTGTCA

AATTTTGATGCATACCAATTGTTGGTGAATGATAGTTTAATGAAATATAAGCCATACGTC

ATGACCCCTTTCTAATTCTACTTTATCAACATTTTACGCTTAATCAATTCACTTTAAAAT

CATTTTCAACAAAAAAACCGAATACAAATGTATTCGGCCTAAAAAAGTATTTACGCTTTT

TCTTTATGATCTTGCTTGCGTTTTCTAAACAATAGTAATGATCCTAATAATGCCATCATT

GCACCAAATAAAGTTGCATTTGTGTTTTCGCTCTTATCTCCTGTTTCTGGTAAAGCATCA

GTTTTGTGTTGTTTTGAGACCTTATTAGAATGGTTTACTTCACCTTTAGGATTTGATGGT

GCTTTCTGTTCATTATTTGGTGGTGTAACTCTTGAATCGGAGTCACTATCTGAGTCTGAG

TCGCTATCTGAATCCGAGTCGCTATCCGAGTCTGAGTCGCTATCTGAGTCTGAATCGCTG

TCTGAGTCTGAGTCGCTATCCGAGTCTGAGTCGCTGTCTGAATCTGAATCACTGTCTGAA

TCCGAATCGCTATCTGAATCTGAATCGCTATCCGAGTCTGAGTCGCTGTCTGAATCTGAA
```

TABLE 7-continued

```
TCGCTGTCTGAGTCCGAATCGCTATCTGAATCTGAGTCGCTGTCTGAGTCTGAATCGCTA
TCTGAATCTGAGTCGCTATCTGAGTCTGAGTCGCTGTCTGAGTCTGAGTCGCTGTCTGAG
TCTGAATCGCTATCTGAATCTGAGTCGCTGTCTGAGTCTGAGTCGCTATCTGAGTCTGAG
TCGCTGTCTGAATCTGAGTCGCTGTCTGAATCTGAATCGCTGTCTGAGTCTGAATCGCTA
TCTGAGTCTGAATCGCTATCTGAGTCTGAATCACTGTCTGAGTCCGAGTCACTGTCTGAA
TCTGACTCACTATCTGATTCTGAGTCGCTATCTGATTCTGAGTCGCTGTCTGAATCTGAA
TCACTGTCTGAATCCGAATCGCTATCTGATTCTGAGTCGCTATCTGAACCTGAGTCGCTG
TCTGAGCCTGAGTCACTGTCTGAATCCGAATCCGGATCCGGGTCTGGGCTTGGTTCCGGT
TCTGGGTCTGGACTTGGTTCTGGATCTGGCGTTGGTTCTGGTTCTGGGTCTGGACTTGGT
TCTGGGTCAACCGGCGGCCCTGGAGTTGGGTCTTTCGGATTTACTGCTGAATCACCATCA
GCACTTCCACCACCATAACGTACAACATTCTCATTATTCCAACCGAAAATACTGTAGTCT
CTATTTGTTACAGGATCAACATTTTCTTGAATAACCTGAGTTTTTAAGTTCTTACCTGTA
TTGTCGTAATGCCCTTCTACTAATACTACATATGTTTTAGTAATATCACCAAATTTAATA
CTAGCTACATTTGGATGCTCATAATAGATTCTATTTTTAAATTGGTCTGTTACTTCTTTA
AGGTTAGAGTCATTTGGATCTGCATAGTAGCTATCTGATAATTTAGATGTATCATTCACT
TCAAAAATTCTCAGTTTTGTATCTGTAGCACTTACTTTACCGCTACTTTCTTCGATTTTA
TCTTGGTAGCCTTTAATATACACCCACGTATTACCTAAAACTCGTTGCTTAGGGTTAACA
AATACTGTTTGCTTGTATGTGTTTTGACCTGAAGCTGTATCTACACCAATAATTTGAGAA
GAAATGTTCGCGCCATTTGGTTTATCAATTCCTGCAATTGGCGAACTATAGTTATAAGTA
ATTTTATTATTAAACATTTCATCCGCAATATTAATATTCGCATCATATGTTCCTGATTTA
GGTGCCTTTGCTCGGTCTGTAAATAAAGGTAATGAAAATTGTCCGTTAATATTTCTTTA
TTATTTACATAATCTGTAAAGACAAATGTATACGTCTTAGTCAAGATATCATATGTTGCT
TTAGCTACAACATCGCCATTCGTACTTTTAATGTCTGCAATTGGCATCGTATTATTTGAA
TTAGAATAATCCACGTCTCCATTACCAGTTAAACTATCTGGTAACTTCGCTGTAAAATAA
TCCCCTGATTTCACTTTATCTGTCACTGTAAAATTTGCCGCCATAAATGTGTTACCACTT
TGATTAGGGTCAAATGTAGTCTTTTCTAACTTGAAATTACTTGCCGTAACTTTATCATTT
ACATTTGTACCTTTAGCATCAGCAGCATTTACTACCGGTTCAGCAACAGCTAAACTACGT
ACAGCTCTCGTTCTAACACTTGGTTTACTAGTTCCTTGCGCATTGGAAATCGTTTGTGGT
GATGATTGTGGTAAATCTAATGTTTGAGAATTTTTAAGCTCACTGTTTGTTGCTATGCTA
TTAGCATCATTCGTTGTTTTATTATCTACTTGAGAATTTGCTTCTTGAGGAACAGTTTGA
TC
```

LOCUS 30 (N15)
```
GATCCATTTGTCCCTACCGCTCGTCTTACATCAAAGTTTACCTTGCTCATTTAATGAAAA
TGAGTTTGTGGATGGTCTACATAAGCACGCACCTCGCCTTTAGCATTTGCATCGGCAATA
ATTCGTCCAATAGGTCCTTGGCCATCTACAGTGACAGTTAATTTTTGATCACCTTTCAAC
ATTGCGCCCATCATAGCTGTTGCTGTCATTGTTCTTCCCATTGCAGCAGATGCTGTCGGC
CATGTATAATGTCTCGTTTGTGCTTCTTGAACAGTTTCAGTTGTCAAAGCAGCATAAGCC
CTAATCTCTCCATCAAATGCTAATGCTTTAACAATATAATCGTGTGTCATTATTTCAATC
TCCTCTATTACTCTATATTTAAAAAATTACTTTACTTCATAAAATGCAACAATTGTACTT
ATTCTACACCCATCATTCTAAATAATGAAGTAACTTGTTTTACAATTATTTTCTGCTATA
```

TABLE 7-continued

ACAATTCAACGACTTAAAATCTAATACGTATTTTCAAAAACGATAAAAGTACCTCTTTCT

ATAACTTTATCATAGAAAGAGGTACTGAATATAATCGATTATTTATTGTCTGGGTGATTT

GGATCGTAAGGTTTTTCGATATTTGGGGCTTGTCGATGTGCTGGTTCATCTTTTTCATCA

GATTTATCAGCTTCTTTTTTATCCTCAGCAATATCTTTTTCTTTACTACGATCTTCACTT

TCGTCACGTTGTCCATCTTCTAATTGCTCTTTACGAATCTCTTCATAAGATTTACCGAAT

TTACCATCATTAAATTCAGAATCTTCATCTTTAACAACTTTAGCTGCATCATAATCAATT

TCAGGTAATTTACCTTCGTAGAATAATGATTGAATTTGTTCAGCAACTAATGTTTCTTCT

GTTAATAATGTTTCAGCAATTAAAATTAATTGTTCTTTGTGCTCTAATAAAATTTGTTTA

CAACGTTCGTATTGTTCTTTAACGATTCGTTGAACTTCTTTATCAATTTCATATGCGATT

TGGCTTGAATAATTAGGCTCACCTTGCATATCTTTACCTAAGAATACTTGACCATTGCTA

TGACCGAACTGTAATGGTCCTAATTTTTTACTCATACCATATTGCGTAACCATTGAGCGT

GCGATTTGTGTTGCACGTTCGAAGTCATTTGAAGCACCTGTTGATACTTCGTTAAAGTTA

ATATCTTCTGATACACGTCCACCAAGTAAACCACAGATTTTATCTAATAACTCTTGTTCA

GTCATTA

LOCUS 31
ACGATGGTGTCTTGCAACATCGAAAATAATGTTGTGTAAGAACGTTGTTCTACCATATCC

TGGACTTCCGATTAACGCGATGTGCCCAGCTTTTTTCAATTGCCATACGGTCGGTCCTTG

ATATTGTTCTTCTGGTACGTCTTTAAGTCCTAATGTTAATTCCACTTCTTTTGCATCATC

TGACCATAATTTTCTGAAATCTGTTTCTACTAAATCTTCTTGATATACATTTTCTGGCAA

TGGTGGTAGCCATGGACGCTTAACTTCTTCGATTTCTAATCGTGTTGTAATAGATTCGAT

ATGATCTATGACCGCTTCTAACTCAGTTTGATTTTCTTTCGTTTCTTCATCTTCAAGTCC

ACTCAAGTCTTTGTTGATTGCTTGAAGTTGACCATAGTCATTAATCATGTAAATCGTCTT

ATCTTCAATTCTAATTTATCGCCTTCGATGTCATATGTTGCACCCACTCCATGCAGATTG

GAATAATTCATAAATTTCATTATTACCAACTTGTAAATACGCACGACCTGGTAATGTAAT

GTCTGCTGCATCTGGTGTTTTTAAAATTTCATTACTGTCTTGTCTATCTTGTACTTTTAA

TGCCAACTTAAAATTAGAGTTAGACCAAATTTGGTCATCAACAACACCCGATGGTTTTTG

TGTCGCAAGTATTAAATGAATACCTAACGAACGTCCAATACGTGCCGTTGATACAAGTTC

TTTCATAAAATCAGGTTGTTCTGATTTTAATTCGGCAAACTCATCGGAAATAATGAATAA

ATGTGGCATTGGTTCTGTCGCAATACCTTCTTTAAATAACTTATGGTATTGATTAATATG

GTTAACATCATGCTCTCCGAATAAACGTTGACGTTTTCTCAATTCGGCTTTGATTGATGT

TAAGGCACGCATCGCTTCATCGCCATCTAAGTTTGTAATCGTACCAACTAAATGGACTAA

ATCTTTAAATAAGTTCGCCATACCCCCACCTTTATAGTCAATCAATAGGAATGCAACTTC

ATGAGGGTGAAAATTAATAGCTAAAGATAAAATGTATGATTGGATAATCTCAGATTTCCC

TGAACCAGTGGTACCAGCAACTAAACCATGTGGCCCGTGTGCTTTTTCATGTAAGTTCAA

TGATAAAATATCATCTTTACCTCTTACACCTAAAGGTACTGCCATCGTTTTGTATGTTTC

GTTTTGTCTCCATCGATTAACCACATCAAGCTGATC

LOCUS 32A (HE9)
GATCAGATAGATAAAGTATTTTCTTTTTATTATGTTTATCAGAATATGCGCCACCGAAAA

TACCAAATATAATAAATGGAAGTGTTTGACTCATAACCATCATTGATAATTTTAAAGATG

ATTGGTTTGTCAATTCAACAGTAAACCAAATTATTTGTAACGAAAACAGCACAAAACAAC

TCCGACGTAAGAAATTACCAATCAATAAATATGTAAAGTTTCTATTTTTCAAAACTTCTA

TABLE 7-continued

```
AATACAACATATTTATCACCTCTCATAAAAATAATTGAATGCATCCACCAGCTTTTTTAG
ACCTTCTTCTAAACTCTCTTTATCCAAAGCGCAATTAATTCTAATATAATTTAGTCAGTT
AAATATCAATTATTTCGAAATATACATACTACTTGAAACACCATACATAACCCCCAAAAT
GACTACTCAGAGGTTATATTCTACTAATTATGATTATATTAAATATGAAAATATTATCAA
AAAAATCAAATTTATAACAAAAATACACCCCTTAAAGTTAGGTCTTTCAATCCAACTTTT
GGGGTGTATATCATTCTCATCATATTCTAGGTTGTTTTTAACAAACTAAATATAGTGAAT
GCAAATCAACTATTATTTAAATTATGAATTATTTTAATTCTTTCTTCTACGAGCCAATAA
CATTAATCCAGCAATTCCAATTATACTACTAAAGATCAAACCTTTTTGCGTGCTTTCTAA
ACCTGTTTTTGGTAATTCTGCTCGTTTTTCTCTTGATTACCTACTGATTCTTTAGCAAT
TTTAGATTTTTTAACTTTATCATTTTTATCCATTGAATGAACTGGGCCATTTGGTTTTGC
TCTGTCTTTCGATAATCCTGGATTGTTAGGATTTACTGGGCCACTTGGATGAGTTGGTCT
GCTCGGCTTCTCTGGGTTTTCAGGTCCTTTTGGATCTTTTGGTTTCTCTCCACCGAACTC
TACAATCTTATCTACTGGTTGTTTTGTGATCTCTTCTGTTGGTTGACCCTCGCCAACTTT
TTCACCTGTTAATGGGTTCACTGTGATTGGTGTTGTGATTGTCTTACTTCCTGGTTGTCC
TTCTTGTTTCACTCGCTCTTCACCAGGTTGTAATTTTGGATTAAACTCACGTTTTGTTTC
AAACGGTATCTCTACTGTTTTTGTTTCTGGTGTACCCGTTTTTGGTCCGTGTTTAATCAC
ATCATCCACTGGCTCTTCGATCACTTTTCCTGTGTCTGGATTCTTGATTCCTGGTTTACC
TGGTACTTTTTCCGTTTGATCTGTTGGTAAGTTTGGATCAAAGATATCTTTATGACCTTG
CGGTATTTTCTCGCCACCGAATTCTGTTAATTCATTAACTGGATCTTTTGTGATTTCTTC
TTTCGATTCACCTTTACTAATAATTTCTCCAGTTAATGGATTTTTTAGTGTTGGCGTCGT
TATTGTCTTCTCACCTTTTTGTCCTTCTCTTGTTACTTTTTCTGTCCCTGGTGCTAAATC
AGGATTAAATTTACGTTCTTTCTCGAATGGAATTTCTTCTTTTTCTACAATCGAGTCTCC
TTTTACAGGTCCATATTTTGTTACGCTATCGACCGGTGGTCTAACTACATCTCCTGTTTC
TGGATTCTTAATTCCTGGTTTACCTGGAACTTCCTCTTTCTCTCCTGTTGGTAACTTCGG
ATCAAATTCGTCTCGATGACCTCGTGTTATCGTTTCTGGTCCGTATTCTGTTAATTCATT
AATCGGATCTTTTGTGATTTCTTCTTTCGATTCACCTTTACTAATAATTTCTCCAGTTAA
TGGATTTTTTAGTGTTGGCGTCGTTATTGTCTTCTCACCTTTTTGTCCTTCTCTTGTTAC
TTTTTCTGTCCCTGGTGCTAAATCAGGATTAAATTTACGTTCTTTCTCGAATGGAATTTC
TTCTTTTTCTACAATCGAGTCTCCTTTTACAGGTCCATATTTTGTTACGCTATCGACCGG
TGGTCTAACTACATCTCCTGTTTCTGGATTCTTAATTCCTGGTTTACCTGGAACTTCCTC
TTTCTCTCCTGTTGGTAACTTCGGATCAAATTCGTCTCGATGACCTGGTGTTATCGTTTC
TGGTCCGTATTCTGTTAATTCATTAATCGGATCTTTTGTGATTTCTTCTTTCGATTCACC
TTTACTAATAATTTCTCCAGTTAATGGATTTTTTAGTGTTGGCGTCGTTATTGTCTTCTC
ACCTTTTTGTCCTTCTCTTGTTACTTTTTCTGTCCCTGGTGCTAAATCAGGATTAAATTT
ACGTTCTTTCTTGAATGGAATTTCTTCTTTTTCTACAATCGAGTCTCCTTTTACAGGTCC
ATATTTTGTTACGCTATCGACCGGTGGTCTAACTACGTCTCCTGTTTCTGGATTCTTAAT
TCCTGGTTTACCTGGAACTTCCTCTTTCTCCTGTTGGTAACTTCGGATCAAATTCGTC
TCGATGACCTGGTGTTATCGTTTCTGGTCCGTATTCTGTTAATTCATTAATCGGATCTTT
TGTGATTTCTTCTTTCGATTCACCTTTACTAATAATTTCTCCAGTTAATGGATTTTTTAG
TGTTGGCGTCGTTATTGTCTTCTCACCTTTTTGTCCTTCTCTTGTTACTTTTTCTGTCCC
```

TABLE 7-continued

TGGTGCTAAATCAGGATTAAATTTACGTTCTTTCTCGAATGGAATCTCTTCTTTTTCTAC

AATCGAGTCTCCTTTTACAGGTCCATATTTTGTTACGCTATCGACCGGTGGTCTAACTAC

ATCTCCTGTTTCTGGATTCTTAATTCCTGGTTTACCTGGAACTTCCTCTTTCTCTCCTGT

TGGTAACTTCGGATCAAATTCGTCTCGATGACCTGGTGTTATCGTTTCTGGTCCGTATTC

TGTTAATTCATTAATCGGATC

LOCUS 32B (P9)
GATCAAATTCGTCTCGATGACCTGGTGTTATCGTTTCTGGTCCGTATTCTGTTAATTCAT

TAATCGGATCTTTTGTGATTTCTTCTTTCGATTCACCTTTACTAATAATTTCTCCAGTTA

ATGGATTTTTTAGTGTTGGCGTCGTTATTGTCTTCTCACCTTTTTGTCCTTCTCTTGTTA

CTTTTTCTGTCCCTGGTGCTAAATCAGGATTAAATTTACGTTCTTTCTTGAATGGAATTT

CTTCTTTTTCTACAATCGAGTCTCCTTTTACAGGTCCATATTTTGTTACGCTATCGACCG

GTGGTCTAACTACGTCTCCTGTTTCTGGATTCTTAATTCCTGGTTTACCTGGAACTTCCT

CTTTCTCTCCTGTTGGTAACTTCGGATCAAATTCGTCTCGATGACCTGGTGTTATCGTTT

CTGGTCCGTATTCTGTTAATTCATTAATCGGATCTTTTGTGATTTCTTCTTTCGATTCAC

CTTTACTAATAATTTCTCCAGTTAATGGATTTTTTAGTGTTGGCGTCGTTATTGTCTTCT

CACCTTTTTGTCCTTCTCTTGTTACTTTTTCTGTCCCTGGTGCTAAATCAGGATTAAATT

TACGTTCTTTCTCGAATGGAATCTCTTCTTTTTCTACAATCGAGTCTCCTTTTACAGGTC

CATATTTTGTTACGCTATCGACCGGTGGTCTAACTACATCTCCTGTTTCTGGATTCTTAA

TTCCTGGTTTACCTGGAACTTCCTCTTTCTCTCCTGTTGGTAACTTCGGATCAAATTCGT

CTCGATGACCTGGTGTTATCGTTTCTGGTCCGTATTCTGTTAATTCATTAATCGGATCTT

TTGTGATTTCTTCTTTCGATTCACCTTTACTAATAATTTCTCCAGTTAATGGATTTTTTA

GTGTTGGCGTCGTTATTGTCTTCTCACCTTTTTGTCCTTCTCTTGTTACTTTTTCTGTCC

CTGGTGCTAAATCCGGATTAAATTTACGTTCTTTCTTGAATGGAATCTCTTCTTTTTCTA

CAATCGAGTCTCCTTTTACAGGTCCATATTTTGTTACGCTATCGACCGGTGGTCTAACTA

CGTCTCCTGTTTCTGGATTCTTAATTCCTGGTTTACCTGGAACTTCTTCTTTCTCTCCTG

TTGGTAACTTCGGATCAAATTCGTCTCGATGACCTGGTGTTATCGTTTCTGGTCCGTATT

CTGTTAATTCATTAATCGGATCTTTTGTGATTCTTCTTTTGGTTCACCTTTACTAATAA

TTACTCCAGTTAATGGATTTTTTAGTGTTGGTGTCGTTATTGTCTTCTCACCTTTTTGTC

CTTCTCTTGTTACTTTTTCTGTCCCTGGTGCTAAATCAGGATTAAATTTACGTTCTTTCT

CGAATGGAATCTCTTCTTTTTCTACAATCGAGTCTCCTTTTACAGGTCCATATTTTGTTA

CGCTATCGACCGGTGGTCTAACTACATCTCCTGTTTCTGGATTCTTAATTCCTGGTTTAC

CTGGAACTTCCTCTTTCTCCTGTTGGTAACTTCGGATC

LOCUS 33(O14)
GATCGATAAAATAGTTTATGCCTGGGCGAAAACCAGGTGAGGTTTTGACGATAATGTATG

AACCATTGATGATTGAACTTAGAACTTCATGTTCACAATAGTGTCTAAACTTTTCTCTCA

TCTCTTGTTCTGTTTGATTATTAATAGCTTTATAAATCCATGTCTCACAATCGATAGGGA

CACGATATATTTAGTTCCTTCAAGTCTTTAGCAATTGTTGTTGCACTATATCTTACAC

CAAAATATTCTTCAATATATGAAATGATTTGTTCTTTTTTATAAATCTTATGCTTTTTAA

CTATTGTAGAAACAATTTCTAATCGTTTACTTTTCTTCATATTGTAAACTCCTTTGGTAG

TTACGTTTCTTGTATTAAAAAATAAATTCATGCATGTTTCATTTATAATTTAACACTTTG

TTTTGCAAAAGATAATAAAAATACATGTAAATTTTTTGTGACAACTTTTAAAATGAATTT

TABLE 7-continued

```
TGTATTCTAAGTCAGCATTTAATTATCACATATCTACTACTTGTAATGATTTTAGACTGC

CGAGTAGTCTTTCGGCAGACAACCCTCACACTCCTCTCATCTAATTACAAAGAGAGGGTA

TACCTACAAAGTCAATTATCAATGTAGGTATACCCCATATATAAGCTGTATTTAAAATTT

AATTATTTATAAGTGTTTAACATTACTTCTTCTTGTTTATATATTTTTACTCCACGCCTA

CTTCATTCCATGCTTCATACACCTGTTCAGCTGTTTGCTCGTCATATAAATCTTTAGCCG

CTTGGTATAATGCATCTTTACAATCTTTGAAGTTTGAATTACTTGTTAAGTATTCCGTTA

ATGCTCGGTAGTAAATTTGTTCTGATTTAGATTTCCCTATTGCTTGAATCACGTTATAAG

CTGCTTTATTTGGAATTCCAGAATTCGTATGTACGCCACCATTATCTTTTTCAGTGAATA

CATAGTCTTTCATATGAGCTGGTTGACCAAATTGTTCTGGGTTTGACATGCTGCGTAAAG

CGTCTCCCCTCTTTTCCAGGTGTGTAGACATCTTCACCATTAAGAAATCCTCGTCATCTA

CAAAGTATCCAAAAACATCTGAAAAGCTTTCATTTAGAGCGCCTGACTGGTCCTTATATT

CTAAGTTCGCTGTCTCTTGTGTCACACCGTGTGTTAATTCGTGTGCTACTACGTCATTTG

CACCCGATAAACTTGTGAATGTGCGACCATCACCATCACCATAGATCATTTTGTCACCGA

TCCATGCGGCATTATTTCTGTTATCTTGACCACCGTAGTTATTAACATGCGTTAATGAAA

CAATTGGACTACCTTGGTTGTCATATGATTCACGACCAAATGTGTCTTTGTAATAATCAT

ATGTTTGTTTAGCGTAATAATTTGCATCTACGCCAGCACGTTGCTCATCTTTTACGAAGT

TTTCATCTTCATTAGTAATCAATGTTGCTTG

LOCUS 34 (O18)
GATCCTTTGTCACTACCTGAAGCAGAATTTTTATCATCTTTACCTGGTGCATTAGCACCT

GCTACATCAGTTGGTCCATTAAATTTATATGTAATGTTGTAATGATGGTCATATTTGAAT

GGCTTTCCATTTACTTTTTCATCGATATAAACGTCAATTTTTCCATCTATTTTACCGTTC

AACTTACTTACTTCAAATTCAGAAGTGCGTTCATCTTTGGCAGTGTTTTTACTAATAATA

TTTTTCTTTATGTCCTTCGATACCATTCCAGTAATCCAATGACTGTGGTTGACAGTTATT

TGAACATACAATTTACCATTTTTCTTAATGTACTTTGCCGGTTTATTAAAATAGTCATTA

GCAATTGACGTGTCATTGGTATTGTATTTGTAAACCTCATAATTCAAAGTACCGCTATCT

GCGGCATTTGCAGAATTACTGAATGTCGCGATGATGATAATTAACGCTAAAATCGTTGTA

TTAAAAACTTTTAAAATATTTTTCAAAACATAATCCTCCTTTTTATGATTGCTTTTAAGT

CTTTAGTAAAATCATAAATAATAATGATTATCATTGTCAATATTTATTTTTTAATCAATT

TATTATTGTTATACGAAAATAGATGTGCTAGTATAATTGATAACCATTATCAATTGCAAT

GGTTAATCATCTCATATAACAACACATAATTTGTATCCTTAGGAGGAAAACAACATGACA

AAACATTATTTAAACAGTAAGTATCAATCAGAACAACGTTCATCAGCTATGAAAAAGATT

ACAATGGGTACAGCATCTATCATTTTAGGTTCCCTTGTATACATAGGCGCAGACAGCCAA

CAAGTCAATGCGGCAACAGAAGCTACGAACGCAACTAATAATCAAAGCACACAAGTTTCT

CAAGCAACATCACAACCAATTAATTTCCAAGTGCAAAAGATGGCTCTTCAGAGAAGTCA

CACATGGATGACTATATGCAACACCCTGGTAAAGTAATTAAACAAAATAATAAATATTAT

TTCCAAACCGTGTTAAACAATGCATCATTCTGGAAAGAATACAAATTTTACAATGCAAAC

AATCAAGAATTAGCAACAACTGTTGTTAACGATAATAAAAAAGCGGATACTAGAACAATC

AATGTTGCAGTTGAACCTGGATATAAGAGCTTAACTACTAAAGTACATATTGTCGTGCCA

CAAATTAATTACAATCATAGATATACTACGCATTTGGAATTTGAAAAAGCAATTCCTACA

TTAGCTGACGCAGCAAAACCAAACAATGTTAAACCGGTTCAACCAAAACCAGCTCAACCT
```

TABLE 7-continued

```
AAAACACCTACTGAGCAAACTAAACCAGTTCAACCTAAAGTTGAAAAAGTTAAACCTACT
GTAACTACAACAAGCAAAGTTGAAGACAATCACTCTACTAAAGTTGTAAGTACTGACAC

LOCUS 35A (P13)
GATCAATACTATTTTCACCTGTCGTTTTCCCTTGGTCTACATCATTTTGACTATTAGCAG
CTTCAATGTTGCTATTTGCTTGTGTCACAGCATTATCTACGTCCGCATTAGCCGCTGCAA
TTTCTTCAGCAGTAATGTCTTGCGTTTGAGCGAITGCTGTTTTACGTTCATTCGCTTTCG
TAGCAATTGCTTCTTTCGCATTATCTTTAGTTGTTGTTGCTGGCTGAATCGCTTCAATTT
TAGCAATTGCTGCTTTTTTAGCCGCTTCAACTTCCGCATTTGTATGTGCTGCATCTATTG
CGGCATCAGCTGTTGTTTTTCAGTTTGAACTTGTTGTTTAGCAGCTGCTTTTTCTTCAG
TTGTTGAGCCGTTATTTCCATCAATTGCTGTTTCTTGAGCTTGTACTTTATCTGCAATTG
CTTGTTTTGCTGCTGGTTTAACATTTGCATCAGGTGTAATGGCTGCGATTGTAGCTTCAT
TTGTAGTTTTTGCATTATCCACATCATTGTTTGCTGCAGCATTATCTATATCAGCGTTTG
CAGTAACTACTGCTTGATCCACTTTGTCTTTCGCTGCTTGTTGTTCTTCAGTAGTCGAAT
CATTCATTGCTTCAATTGCTGTTTTACGTTCACTTGCTTTTTGAGCGATTTCCGCTTTTG
CATCCGATTTCTTAGTTGTGGCAGCTTGAACTTGATTAATTGCAGCAATACTATTGTCTT
TAGCTGTTGTTACATCACTGTTTGTATTTGCAGCATCAAGATTTGTTCTTGCTTCTTGCT
TTTTAGTATCTAATTCTGTATATGCAGCTTGTTTTTCTTCTGTAGTTGAAGCATTGCTAT
TTTGAATTTCTTGTTTACGTGTATTATATGCGTTTTCTACTTCCGTATCAGCTGCAGGTT
TAACTTTTGCTTGTGTTTGAATTGCATTGATTTTATCTAATACTTTTGATTTTGTATCAG
CAACTTCCTGTTTTGATTTAACAACTTGGATGTCATGTAAACCTTGCTTTTGAGCTGCAT
CTACTGCTGCATCAGCTTCTGCTACTTCTTCATTTGTTGCATTTGAAACTGTAGCATTTT
GAGCTTTTCTAGCTGTTGCAGCTTGTTTAACTTCATTATAGGCATCCATTTTTCTTTGCG
TAGAGTCAGTAATATTTTCAATTTTTGAGATTTCTTCGTTTTTAACTCTTTCTAAATCTT
GTGCAGTCGTTGTCGCTTCAATTGCTTTAACACCAGAAACTTTAGCTGCATTAATACGTT
CAATAGCTTCCGCTACTTCTTCATTTGTTGTATCAGGATTTAAAGGTGCTTGATCAATTT
GTGCTTGAACAACTTCGTCAAATTCTTCAAGAGCTGCTGCTTTAGCTGTTGTAGCAGGTG
TAGTTTGATTAATATCATTGATTGCTTTTGTTTTAATGGCTTCTACTTGTGCATTTGTTG
TTGCTGCATCAATATCTTTAATTGCCTTTGTTTCAATTTTACCAATTTTATCATTTGCTA
CATCTTTTTCATCTTGTAATGATGCATTTGACTTTTTAATTTGTTGTTTACGAGTTGTAA
CTGCTTGGATAATATCTTGTTTCGCTTGAGGTTTAACTGTTGGTGTAATCACATCTTGTT
CTAACACTGCGATACCATTATCTTTTTCAGTTGTGACACCTTGTGCTGTAGTTTGTTTAT
TAATTTCTGCGATTGCATTATTTTATCATTGTTAATTTTAGTTACAAGTGCTGCAACTT
CATCTTGCGTAACTTTTTACTTTGTTGTGCTGCTGTAACCTTTCTTGAGCTTTAGTAT
CTAATTCAGCAATTGCTGCTTGATTATCAATTAATGCAGCTTGTAATTTAGTTACTAAAC
CATCAATATCCGCTTGAGATGCACGATTTGCAGTTTTAACATGATTCGCATCTTCATTTA
AAATAGTATCTGCTTGTTGTTTAAGTTTATTGTATTGTGCAATTGATGCTGTTGTGTAAT
GACTATTATCAACTTGTGAGTTTACTTGTTGTTGCAACGCATCTTTGTTCATTTCAACCG
CTACTGAAAATGGATCTGCAGTTAGTGTAACTTCTGGTTGCGCATTATTAATTACAACAT
CTGAAGCAGTACGATATGTTAATTTTTCATTAAAATCAATATTTTTAGGTGTATCGATAT
TCGCAACATTAACTTTATATGATAATTTTAAAGATTTATCTGGGAATAAAACTTCTTTAG
```

TABLE 7-continued

```
TGTGTGTACCACGTGCCGTTGTCACACCTTGGCTTGTAAATGTAAGTTTATTTGCATTTT

GATCATAATTAACAGTCATATTTTTCAATACTGTACTGTCTTCATTACCATTAGGGAATG

TTGTAGTTAATGAATTATTAACGTAAGTTACACCTTGTGGTAATGTTACTTCATATTTAA

ATTGATC

LOCUS 35B (P15)
CAATTCTTATTTATCTGATGAAGTAACACGTGTCGGACGAGGTACATTACGTAAAATTGG

CCCTAAAGATAGAATTATAAAACCATTAACATATCTTTATAATAAAGATTTAGAACGCAC

TGGTTTATTAAATACAGCTGCATTGTTATTGAAGTATGATGATACAGCAGACCAAGAAAC

TGTTGAGAAAAATAATTACATTAAAGAACACGGTTTAAAAGCGTTTTTAAGTGAATATGC

TAAAGTTGACGATGGCTTAGCCGATGAAATAATTGAAGCGTACAATTCACTTTCATAATT

TATTGAGCTTTGTTTGAAACAAGAAGTTTCCAACGTTATTCGTTAACAATCAGTAATAAT

GTAGTAGTTCCCTTGAATTAACAATATTAAATTTCTGAACATAAAAAATACTCCCTTCAA

CATAGACACTTAACTTGTGTTATGTATGAAAGGAGTATTTTGCGTTAATAATTTGTTTT

ATTTTCGAGCCACAGCCACCTATTCAATGGCTATTGGTCATTACTAAAACAAATTCATAT

TAACTGTTAGACTTGGTTACTTAGTAAGGAATATTTCCCTATGAAATAACTAGATGTTCA

CATTCTTGAATAAATTTTATTCTTCAGTTTGTTGGTCTTTCTTAGTGAATCTTCTAATTA

AGAATGCCATACCTGCACCTAGAGCTAATTCAGCATATGGTAAATCGTCATTATGTGACA

TACCAGTATCTGGTAAAGTTTTAGCTTGTTGTTTAGCTTTATTAACTTTTCCTTGTTGAG

CTGATTTTGTCTTAGCTTGGTGGTCGTCAGTGTTAGTTACATTAAGCATATCTTGATTAG

CACTATTGCTTCCATTTGAAACTGTAGCTGGAGATGCATTGGCACCGTCGTTTTGCGTAG

CTTTATTGTTTGCAGCTGAACCAACTGATTTTTGCGTATCATTAGTATCTGCTGTTGCCG

TATCATCTTTTTGGCTAACATTAGTTGAAGTCATTTTTTCTTTTGCTTCAGAAGATGCAG

ATGTTGATGGTTTATTCGAAACTTCAGTATCAGCTTTGCTTGGCGATTTATCTGCTTCGT

TAGATGCAACGTTAGTTTCAGACTTAAGTTGTCCTGCATCAGTTTGATTTGTCGTACTTT

CTTCTTTATCTTTTGATGTATTAGAAGGTACATTTGGTTCTGTTATGTCTGCTGAAGGCA

ATGTTTCAGTTGTTGATTCAACCATACTTTGATTTGTTGAATCACTACCATCTTTTTCTG

CCTTAGCTTTATTTTCAGATTTTGGTTGTGCAACCTTGTCATTAGTTGATTGAGATTCAG

CACTATTATTTACTTCAGCATTTTGTTTTGAATCATTTACAGATGCATTATCTTTGCTAT

CAGCAGATGATGCTGCTTCTGTGCTCGCAGTTGTTGGAGCCGTTGCTGTTGATCCTGTTG

GTGCATTCTCGTTTGTTGCTGTAGTTGTACTATTGTTATTTGTTGTGCTTTCTGCTGGCG

TTGCATTATCAGTTTCTGTTACAGGTTTATCAGTTGTGCCGTTATTAGTTGATTCTACTT

CTGGTTTACTAGTTACATCGTTATCCATTGTCGGACTGTTTGTTGATGCATCTACACTAG

AATTGTTATTAGCTTGCGGTTTATCATTTGCATCATCAGTTGCTGATGTTGCTGTTGTTT

CACCTGTTGCCGCATCACTATTATTTGGTGTTGTCGGAGAAGCGTCTGCTTTGCCATTAG

CTGTCGTCTCAGATACGTTAGGTTGTCCAGTATTTTCTGGTGTTGCATTAGCATTTGAAT

TTGCTGTTGCATCATTATTATCTATACCATTATTAGTATCATTAGCATCTGGATCATTCT

GAGGCACAATCGCTTCAATTGCAGGTATCGTTACATTTTGTAATTCAGCAACTTCTGCAT

TTGTTTGTGTTTTATCTAATTTATCAGCAAATCTGTCAAAATATCTACCTAAATCCGTAC

GTGCAATTTCTTTCGCCGATGCATCTGCATCTGCATTTTTAATTATTTCTATTTGCTTGT

TAACCACTTCTCTGATTGCTTCCAAAGCATTTTTCTTAACTTCAGGATTAATACGTTGTG
```

TABLE 7-continued

```
CTTTAAGTTGTTCAAGCGCACTATTTTTGACAGTAGCGATTTCTGCATTTGTAGTTTGAT
CAGAAATATCTTCAGTTGCTTTTGATAAAATGTCTTCTAAAGCATTCGTAAACGCTTCTT
TTTCTTCAGTTGTAGCATCAGCGTTGACATTTACACCTGCTTCAATCTGGTCTAGTGCAG
TTTCTAATTCTTCGATAGCTTTTTGTTTTCTGTTGAGTCGATTTGAATGTTATCAAATG
CTTCAAGTCCTTGAGCTTTCGCTTTTTCAACTTCAGCAGTTGTTGTTGCATCAGTAATAC
CTTGTTTAGCTTGATCTGTAATTTGTTTAATCATTGCTAATGCTTCAGTTTTTTCTTCAG
CAGTTAACTGGTCACTTTGATCAATAGATTCTTTCGTATCTTCTGCTTTAACTTCAATAG
CTTGGTTCGCTTTAGGTTTAACAGTAGCATCTACTTGAATAGCATCAATTGCTGCTTTAC
CTTGTGTTAATGCATCATCAACGTCACCATTATCCACACCATTATTAATGCTTTCTAATG
CAGTTTGAACATTTTGGTCAACTTGCTTAATTGCTTGTTGCTTTTCATCTTGTGTTGCAT
TAGTGTCAGCTGAAATATTATTTTTCTTCTGATCTGCATAAGCATATAAATCTGTTGTAG
CTGATTCTTTTTTACCTGTTGGAATTGTGTAATCGTTAATATTATCTAAGTCATTATGAA
TTTGAACTTCAATCTCATCTTTAGAAGTAGCTTGATTAACATTTTGATCCGCAGTTTGTT
TTAATTCAGCAAGTTTTTGTTTCGCTTCAGCAATTTCACTTGAAGTCGATGCGTTAGAGT
TATCCGCTTCGTTTACTTTAGCATTATATGCATCTTCAATTTTAGCTAAAGCATCTTTTT
TGTACTCACTAAATGTTTTAACTGCATTAATTTTAGCTTTTCCTTCTTTAACTGCATTAT
CAACATATTCATTTGTTGATGATTGATCGACATTTGTTTTCGCTTGATTTAATTCAGTAT
CAACTTCTTGTTTTGCATCATTAATTTCTTGTTGTGATGCATTTGGTGTTTGTTCTATTT
GTGTTTTCTTATCAGCTGCAGCTTGATCTAATTCTTTTTTACCTGCTGGTTTCTTAACAG
GATTTGCATGAAGTTGTTGAACTTTTTGTACTGCTGTATCTTTAGCAGTAGTTACATCAC
CTGTAGTAGTTGCTGCATTAATATTATTTAAACCTTCTTCATATGCTGCTCTAACTGGTC
CAATATCGTTACCTTTTCTTCATTAGTAGTCTCATTATTATTAAGTATTTCAGTTATTT
TATTTTGCATTTCAGTTAGCAATTCCGCTCTTGCATTCGTTTTAACATCTGTTGATGCTT
GAATTGGGTCAATTGCTTGAATTGCATTATCTTTTGCAGTGTTTACATCATCGATTGACT
GTGCATTTTCAATATTTTGATTACCTTGTGTTAATTGTGCGTCTACTTGTTGATTTGCTT
GTTCTTTTTCTTCAGTAGTCGCATCTGCAGTTTGTGCAATAAGCGCTTTTTGTTCGTTTG
CTTTTGTTGCTAATTCATCTTTCGCAACATCTTTAATTGTTGTATCTGCAGTAATACCTT
GAATATCAGCAACTGCTTGATCTTTAATTTGCGTAACATCATTAGTTGTTTGTGCATTTA
AGATATCTTGATACGCTTTTTCTTTAGCTTTTAAAACTAAATCTTTTGCTGCATTTTTCT
CTTCAGTTGTAGCACCAGTTGTATTATCAATTGCTTGATTTTGAGTTGTCACAGCTTGAT
CAACATCATTTTTAGCATTTGATTTAACCGCTGTTGCTGGTTGCGTGCTTTGAATTGAAT
TCTTTCCAGCGTCTTTCGCCTGATCTACACCATTATCATCAGTTGCAGCTGTAATATTAT
TTTTCGCGTCTGTAACTGCTGTTGCTAATTGTTGAATAGCTGCTTCTTTTTCTTCTGTTG
TAGCGTTCTGATCATTATTGATAACATTTGTTTGCGTTGCTTGTAATTGATCAATTTCAT
CTTTAGCCGCTTGTTTCTTCACAACTTTTGGTGTTACCGCATTAATCGCTGCTTCTGCAT
TTGCTTTAGCTTCATCAACTTGTGCGTTAGTAGTTGCTGCTGAAATGGCTTGATTTGCTT
TACCATTTTCAGTATTTGCTTCAGCATCAGCTGCTTGTTTTTCTTCATCTGTTGCATCTG
GCGTAGCTTGAATCTCTTGCAATTTGTTATTTAAAATTGCTGTGATTTCATTACGTGCAG
TTGCTTTTTTATTAACTGTTGGTGTTACTTGATCAATACTATTTTCACCTGTCGTTTTCG
CTTGGTCTACATCATTTTGACTATTAGCAGCTTCAATGTTGCTATTTGCTTGTGTCACAG
```

TABLE 7-continued

```
CATTATCTACGTCCGCATTAGCCGCTGCAATTTCTTCAGCAGTAATGTCTTGCGTTTGAG

CGATTGCTGTTTTACGTTCATTCGCTTTCGTAGCAATTGCTTCTTTCGCATTATCTTTAG

TTGTTGTTGCTGGCTGAATCGCTTCAATTTTAGCAATTGCTGCTTTTTTAGCCGCTTCAA

CTTCCGCATTTGTATGTGCTGCATCTATTGCGGCATCAGCTGTTGTTTTTCAGTTTGAA

CTTGTTGTTTAGCAGCTGCTTTTTCTTCAGTTGTTGAGCCGTTATTTCCATCAATTGCTG

TTTCTTGAGCTTGTACTTTATCTGCAATTGCTTGTTTTGCTGCTGGTTTAACATTTGCAT

CAGGTGTAATGGCTGCGATTGTAGCTTCATTTGTAGTTTTTGCATTATCCACATCATTGT

TTGCTGCAGCATTATCTATATCAGCGTTTGCAGTAACTACTGCTT

LOCUS 36 (P5)
GATCATCTCTATCAATTTTTATATTAAATTCATTTTTTTGAATCGATAAAATAAACTCGA

TTAGCTCTTCCTTATAAGACCTATTATATTCAATTATGTTTATAGCCATTTTTATCTCCT

TTTTCATTTAATTTAATTATAAAATGTGCGTTTAGTTTGTATCTAGTGTACTCAGTACAG

CCTCAAATGAAGTTTCATTCCACTTGGCACTTAATAAAGACAAGTATTTTAGCAGTAATA

CAATAAAGTCCAATAAATTTCCCTAACTTCAATATCCACTTTTTAAAAAATGTATTTTTA

ATTAATAAAAAAACTCTCCCCAATTTCTATGGGAAGAGCTATATATTTAATGTCTAAACA

TTACTTTTATTTATTATGAAGGAATTAGAATCCCCAAGCACCTAAACCTTGTGCTTTGTA

TGCTTTAACAGCTGCGTTGATTTGTTGGTCAACAGTGTTTGTTGGACCCCAACCTGGCAT

AGTTTGGAATAAACCTGAAGCACCTGATGGGTTGTAAGCATTTACTTGACCATTTGATTC

ACGAGCGATGATTGCAGCCCATGTAGAAGCTGAAACACCAGTACGTTGAGCCATGATTTG

AGCTGCTGATGAACCAGTAGCACCTGCAGTATTACCATTGCTTAATCTCACTGAACTTGA

AGTAGTTGAAGTGCTGTAGTTATGGTAAGTTGGAGCTGAAACAGCTTCAACGTTTGAGTT

ACTTGATTGTGCATTGTAGCTTACTGATTGTACATTTGAACCTTGGTTGTATGAAGTAGT

GTAGTCTGCACCTGCAACGTTTGAGAAACCAGCAGTTTGACCATTAGCTGCTTCATAGCT

CCATGACCATGTAGTACCATTTGAAGTGAAGTTATATTGGAAACCATCTTTTACAAAGTG

GATGTCATATGCACCATCTTTGATTGGAGCTGCATTTAATTGATCTTGGTGATTATGCGC

TAAGTCAACTAAGTGTGCTTGATCAACGTTTACTTCAGCAGCGTGTGCTTGATGTCCTGT

ACCTGCTGCGTAACCTGTTACACCTAATGCCACTGCTAATGATGATGCCATAATTGTCTT

TTTCATAGTAAAAAATCCTCCAGTAATAATTGTAAGTTTATGTTTTTAGTAATTATATTT

TGAATTTGAATGTCGTAGTGCAAGTTTAAATTGTCTTTTATTTCTTTCAACGGTACTCAC

TATATCACAAAAAACCAGCCAGTAAATTACACTTTCTTTACAAAACATTACAATATCAAG

TGTTATTTGTAATGTTGAAATATGGCTGTTTTATACTGTAATGTGAAATATGTGCCCTTT

AGAATCCAATCAACCCTTGAAATAGTCTTTAACACATAAGATTTTTACTATATTTAGCTC

AACTATTACAGCTTTCGTAATATTACAGATTGTATTTTTGTTACATAGCTGTAATATATC

TGACATGTAACTTCTCTTATTTTCGTACATTAAACGCAATTAAAAAGCAATCAACAAATA

TGTTTCTACACATGTATTGATTGCTATTATTGTTGTATATTCAAAGTTTTAAAACACACA

TCTTTTGTGAATTGTCTTATCTTTTATTAGCGCAAATAAACTGCAGCTCAATTATATTGT

TCAACTTCATTCTCGCAATTCACAATAACATTAAATAATTTTTGGTCTCATATTTTCAAA

AAACATACTGTTATTATCCCATGAATTTAAAAATATCATTAGTATATAAACGAAACACTT

TACGATAAATGATATCTGCAAGCCAAGCTGTTACAAATGGTACAACAAAGAACGCTACTA

CAATTAGTAAGACACTCAACCAAGCAGAATCAACCTCCATAAATTTAAATGCATTAATCG
```

TABLE 7-continued

GTCCTACCATTCCTATAAAACCAAATCCAGCTGACTCTTTCGTTCCATGAATACCTACTA

ATGCTGATACCAAACCTGATACAATGGCTGTCGTTAATATTGGTAACATAAGAATTGGAT

ATTTCACCATATTAGGTATCATCATTTTAACGCCTCCAAAGAAGACGGATAACGGCACCC

CTAAACGATTCACTTTACTTGTACCAATTATCAATACTGCTTCAGTCGCGGAGATACCAA

TTGACGCTGATC

LOCUS 37 (P8)
GATCTGGCGTTGGTTCTGGTTCTGGGTCTGGACTTGGTTCTGGGTCAACCGGCGGCCCTG

GAGTTGGGTCTTTCGGATTTACTGCTGAATCACCATCAGCACTTCCACCACCATAACGTA

CAACATTCTCATTATTCCAACCGAAAATACTGTAGTCTCTATTTGTTACAGGATCAACAT

TTTCTTGAATAACCTGAGTTTTTAAGTTCTTACCTGTATTGTCGTAATGCCCTTCTACTA

ATACTACATATGTTTTAGTAATATCACCAAATTTAATACTAGCTACATTTGGATGCTCAT

AATAGATTCTATTTTTAAATTGGTCTGTTACTTCTTTAAGGTTAGAGTCATTTGGATCTG

CATAGTAGCTATCTGATAATTTAGATGTATCATTCACTTCAAAAATTCTCAGTTTTGTAT

CTGTAGCACTTACTTTACCGCTACTTTCTTCGATTTTATCTTGGTAGCCTTTAATATACA

CCCACGTATTACCTAAAACTCGTTGCTTAGGGTTAACAAATACTGTTTGCTTGTATGTGT

TTTGACCTGAAGCTGTATCTACACCAATAATTTGAGAAGAAATGTTCCCGCCATTTGGTT

TATCAATTCCTGCAATTGGCGAACTATAGTTATAAGTAATTTTATTATTAAACATTTCAT

CCGCAATATTAATATTCGCATCATATGTTCCTGATTTAGGTGCCTTTGCTCGGTCTGTAA

ATAAAGGTAATGAAAATTGTCCGTTAATATTTTCTTTATTATTTACATAATCTGTAAAGA

CAAATGTATACGTCTTAGTCAAGATATCATATGTTGCTTTAGCTACAACATCGCCATTCG

TACTTTTAATGTCTGCAATTGGCATCGTATTATTTGAATTAGAATAATCCACGTCTCCAT

TACCAGTTAAACTATCTGGTAACTTCGCTGTAAAATAATCCCCTGATTTCACTTTATCTG

TCACTGTAAAATTTGCCGCCATAAATGTGTTACCACTTTGATTAGGGTCAAATGTAGTCT

TTTCTAACTTGAAATTACTTGCCGTAACTTTATCATTTACATTTGTACCTTTAGCATCAG

CAGCATTTACTACCGGTTCAGCAACAGCTAAACTACGTACAGCTCTCGTTCTAACACTTG

GTTTACTAGTTCCTTGCGCATTGGAAATCGTTTGTGGTGATGATTGTGGTAAATCTAATG

TTTGAGAATTTTTAAGCTCACTGTTTGTTGCTATGCTATTAGCATCATTCGTTGTTTTAT

TATCTACTTGAGAATTTGCTTCTTGAGGAACAGTTTGATCTTGCATTTTTGCAGCAGTTG

CTTGATTTTAATTGCCGTCGGTTGAGGTGTTTCATTTGTTGAAGCTGGCTCTGTTGTAG

TGGTATTGCTCGTTTGTGTAGACATTGGTTTTGTTGTGCTATCTACATTCGCACTGTTTG

TGTTTGCACTAATATCAGATGTATCATTAGCCGTTGTATTTAATTGAGGTGTTTCTATCA

TATTGTTTTTTCGGAATCTGCACTTGCATTATTTTTCGAAGATTGCGTTGTATCGTTCG

ATTGTTCTGAAGCTTGTGCTTGATGATTGCCTATCCCAAATAGTATAGTTGCCCCTACTA

TTACTGATGTGGTACCTACTGTAAAACGTCTAATCGAATACTTATTCTGCTTATTCGACA

AATAATCAATTCTTTTTTTCAAAAATATTACTCCATTTCAATTTCTAGATTAGTCTAAAT

TGTATAATGAAATAAGAATTATATCAATTGCTTTTCGAAAAAAATTACGTAAAATTTGTT

TTCTTCCTATTTATATAACTTAAAATTTTCTGTTAACTAGCAAAAATCAATATACTATTT

TTACACTATTACAAATTTTTTACTTTTCAAAAACTTAGAAGTTCTAAATTTTTCATCACC

TTAAATTTTACTGTAATTTCAACAATCAAATTTAACTAACATTTTAAATTATTCATCATG

CTAGCAAAAAAGGCCTAACGTATAAATGTACGTTAGACCTCATGTTCAACTTATTCATTT

TABLE 7-continued

```
TACATTGTATATTAAACACATACATCATTGAATAAATGTTTGCTTACTAACCAATTTTTA

TGATC

LOCUS 38 (P16)
GATCAGCTAACGCTACAAAACTAATAACAAATGCGATGATGATTAATACTAATTTACCTG

CTGCTAATACAGAATCTCCAAGGAATGAGAAGAATGGTTGACGTTCAACTTCATTGTTTT

TAAGACTGTAAATAATATCTTCTTTCTCTTCAACACTTACTGGATTCAACAAGCATGACA

CAATAATCGCGTTAACGATATTTAGTGGAATTGCCGTTAGTACCAGTTCTCCTGGTACCA

TTTGTACATACGCACCTACAATAGCTCCCGATACAGAGCTCATTGACATCATTGCGATTG

TTAATACACGCATTTCATTCATACGTTTTAGTTGCTCACTTGATACGGCTAATGCTTCAG

TATTTCCTAAGAACATCATTTCTATCCCAAAGAATGACTCGAATTTAGGTTGTCTTGTTA

CTTTAGCTAGTAACCAACCAATACCTCCAATAATTTTCGGTAAAATATTAAAGTACATTA

AGATATCAAATAATGGCACTATTAATAATATTGGGAATAAGGCTGCAACAGCCATATCCA

TCATTTTAACATTTGTCAAACTTGCAAATGCAAAACCTGTACCAGCATGCCCTGACTGAA

CTACCCAAGCGATACCATTGGCTGCTCCTCTTACTGCTTTTTGACCCCAATCAAATAAA

TAAAGAACCATGCTAAAAACAGGTTTAAAACAACTAAGATC

LOCUS 39 (HB3)
GATCTTTCGAAATTGTTTCTTCAAAAGTTTTTGGATGAAAAGTTAATTTTTCTGGAAAAC

ATAACTGTTGTGCCATATATCCAAAACTTTCTTGATATTTTTAAAATTATCGAAATTAA

TCACGGAAAATCCCTCCATAGAAATTCTCATTATAAATTTCTTGACCAGTTTTCCCTGAA

CCTACTGCAACGCCACAGCCTTCACAGTTATCTCCAAAATGCTCGCCGCCGTAATTGTAT

CCTGTACTACCTTGTGCGTGATACGTATCTAAATAGGTTTCTTTGTGTGATGTTGGAATA

ACAAATCGATCTTCATATTTGGCTAGTCCTAATAAACGATACATGTCTTTAGTTTGGCGC

TCGGTTATACCTAATCGCTCTAATCGAGACGTGTCAAATGGCTGTTGAGTAACTTGAGAT

CTCATATAACTTCTCATCATTGCCATACGTTGTAGGGCTCCTTTTACTGGCTCTGTATCT

CCTGCAGTGAAAATATTAGCTAAGTATTCAATAGGTAAACGCATTTCTTCAATGGCTGGG

AAAATCGCATCTGGATTTTGAGTTGTATTTTTACCTTCAAAATAGCTCATAATTGGGCTA

AGTGGTGGGCAATACCAAACCATCGGCATCGTTCTAAATTCAGGATGTAACGGAAATGCA

AGTTTATATTCAATTGCTAACTTATAAATTGGAGAGTTTTGTGCAGCTTCAATCCAATCG

TAACCAATACCATCTTTTTCAGCTTGAGCAATGACTTCTTCGTCAAATGGGTTTAAGAAT

ATATCTAATTGTTTTTCATATAAATCTTTCTCGTCTACTGCTGAAGCTGCTTCATGAACT

CGATCTGCATCATATAATAAAACACCTAAGTAACGCATACGTCCTGTACAAGTTTCAGAG

CATACCGTAGGCATACCCGCCTCGATTCTCGGGAAACAGAAAGTACACTTTTCAGCTTTG

TTCGTTTTCCAATTGAAGTAAACTTTCTTATATGGACAACCTGTCATACAGTAACGCCAT

CCACGACATGCGTCTTGGTCAACTAATACAATGCCATCTTCATCACGTTTATACATAGCA

CCTGAAGGACACGATGCAACGCAACTTGGATTCAAGCAATGTTCACATAAACGTGGTAAA

TACATCATAAAAGTTTCGTCAAATTGGAATTTAATATCTTCTTCTATTTTTTGGATGTTA

GGATCTTTTGGACCTGTAACATGACCACCTGCTAAGTCATCTTCCCAGTTAGGTCCCCAT

TCAATTTCAATGTTATCCCCCGTAATTTCTGAATACGCTCTAGCAACTGGCGAATGCTTC

CCTGATTTCGCAGTTGTTAAATGTTCATAATTATAGTTCCATGGCTCATAATAATCTTTA

ATTAATGGCATATCTGGGTTATAAAAAATTTTACCTAAAGCAATTTTTGAAATTCTACTT

CCAGATTTTAATTCAAGTTTCCCTTTACGATTTAGTACCCAACCACCTTTGTAGTGTTCT
```

TABLE 7-continued

```
TGGTCTTCCCAACGTTTCGGATACCCTACACCTGGCTTCGTTTCTACGTTGTTGAACCAC

ATGTACTCAGCACCTGGACGATTTGTCCAAGTGTTTTTACATGTCACACTACACGTATGG

CATCCTATGCATTTATCTAAATTTAATACCATCGCAACTTGCGCTTTAATCTTCAAGCCA

ATTAACCTCCTTCATCTTTCTAACTGCTACATATAAATCCCTTTGGTTCCCAATTGGTCC

ATAATAATTAAAGTGATAACTAATTTGTGCGTATCCTCCGACTAGTTGTGTTGGTTTCAA

ATGGATTCTAGTCGGCGCGTTGTGTGAACCACCACGTGTATCTGTAATTTCTGACCCAGG

CGTTTGAATATGTTTATCTTGTGCATGAGACATAAACATTGTACCTTTAGGCATACGATG

CGAAATAACTGCTCTTGCCGTTACAACACCATTACGGTTATACACTTCTAGCCAATCATT

ATCTTGGATATCGTGTTTTTCAGCATCTTCATTTGATATCCAAACCGTTGGACCACCTCT

AAATAGTGTCAACATATGCTTATTATCTTGATACATTGAGTGTATATTCCATTTTCCATG

AGGCGTTAAATAACGCAGTACCAAAGCATCTGTACCACCTTTAATTTTCTTATCTCTATT

CCCAAATACCATTGGCGGCAATGTCGGTTTATATACTGGTAAGCTCTCCCCAAATTGTTG

GAAAACTTCGTGATC

LOCUS 40 (HB5)
GATTCATCAATACTTTTGAAACACCACCTAATGATGCAATGTCTTGTTGGGAGTCACCTA

AGTGTCCGGAATGATAGATAACAATATTACCTGTTTCACGTTTTAAAATAAAAGATTTAA

ATAGAAATCGATTATCAAAGGCAGTTCCGAAGTAGGTGTCGCATATAAGTTTTTTGTGA

TGGATTCTAAACTGTCATGTAATTTGGACTGTTTATTTTTAAATTGATTAGTCATTTTAT

TTCATCCTTCGATTAATTTGAATTGTACATACGCAGTACCCTTTATTTAATTTAATAATC

AATGAGAGTCTTTCAAACTTCGATTTAGAATATGCTTCATACAATAAATAAGTACTTGGA

GCACTAAAAAATTAAATCTTTTAGTACAACATTAATGAAAACCTAAAAGTTCATCCTACA

ATGCTACTAAAAAAGGGGAATGGAACAGAAATGATATTTTCACAAAATTCATTTCGTCG

TCCCAGACCCGCTTTGAATTATAAATTATCGTCTTGTTCTTCTTCTGATACTTGAACGAT

TCGCAATGAACGACGTTCAACTTCTTTTAATTTTTCAGCACGCGTTTCAAGTTTAATTCT

ATCGCGCCCTAAAATGATTAAAAATGATATCATCATGAAAATAAAAATAACAATTAATGG

CACACTTGCCAGTATTGAAGCAGTTTTCAATACTTCTAATGCACGTTCACCACCAACTAG

CATCAATGAAAATGGCAATAAGCACAATGCAAATGCCCAGAATAAACGATTGGCACGTAA

TGGTTCGCCTACCACTTTTTTCTGAGATGCTGCCGCTAAAATATATGAACCCGAATCAAA

TGTTGTTGCTAAGAATAAGAAAGCAGATACTAAGAATAGTACAATCATCAATGATGGGAA

TGGTAAATGATGCACCACTTCAATAATGGTTGCCTCTGTACCATGTGTATTTAAATATTG

TGTTACATTAAACTGTCCAGAAATTTGTAAATACACAGCATAGTTACCAAAAATACCAAA

GAATAATACGCATCCAAGCGTTCCATAAATAATTGTTCCTAGCACGACTTCTTTAAGGCG

TCGACCTTTTGAAATTCTAGCGATAAATAAACCGATAAATGGCGCATATACTAACCACCA

TGACCAGTAGAATATTGTCCAGTCTTGTGGGAAATTCGTTTCTTTTCGACCTTTAATACC

ACCGAATGGTTCTAACCATGTTGCCATATGAAAGAAATCTCTCAACATATTTCCGAACCC

TGTCACTGTCGTTTCCATAATAAAAACAGTCGGTCCAATAATAAATATAAAGGCTAAAAG

TACAAAGGATAGCCAAACGTTGATATCACTTAACTTTTGAATACCTTTTTTCAATCCTGT

ATATGAACTAATGGCAAATATAACCGTGATTGTTAATAAAATGGCCGAACGTAAAATCAT

ATTTTTTACCATCTAAACCAGTTAATCTTTCTATGCCTGCAGAAATTAATGGCACACCTAA

CGCTAGTGATGTTGCCGCACCACCTAGCAATCCAAAGATAAATAAGATATCTACAACTTT
```

TABLE 7-continued

```
ACCTACAAATTTATCTGTTTGACCTTTTAAAATCGGACGACAAGCTTGACTAATTTTATA
CACCGGTTGTTTTTTAACAAATACTAAATAACCAATTGGTAATGCTGGTAGAACATAAAT
AGCCCAAGCAATTGGCCCCAGTGGAACATACCATATTGCGTCGCATATTGGAGTGCTTC
ATCACTCATACTTTTCGCGCCATTTGGTGGAACTTGATAGTAAAAAGCCCATTCAATAAC
GCCCCAGTATAAAATATCAGAGCCTATGCCTGCACAAAACAGCATTGCCGCCCATGTAAA
TGTATTAAATTCTGGTTTATCACTTGCTTTACCAAGTGTGACATTACCATATTTACCAAA
TGCGATATACATTACAAAGCAAAAAATCGCCAGCCCCATAAATAAATATATCGAACCAAT
TGAATCAGAAATGGCACTATTAATACCAGTGATGATATCTTCACTTGCTTTTGGAAAAGC
CATCATAGGTATAACTGCAAAAAGAAGTACAGCTACTGTCCCTATAAAGGTCGTCCAGTC
CATAACTTTCTCTTTTTTCAATTGTGCTCCCCCTAATTATTAATTTTATGAATCCTGTTT
CGATTTATCTCAAAATGTAATAATTATATTGATTCACAAAATTGACAATAACTAACATTT
AATAATAATGCAAATTTCATACAATTTGAAACTTGGCAATTATTGAATATTTATATAATT
TTTCCCGTAATAAACAAAACCTTAATAGCGCTAAAATAACAGTGTTAAGTTACGATTTAA
CGAATTTAACAAATTTTACTAGAATGGCATTTAAGAATATTTATACGTTATTAACGAATA
TTTATTTATTGTAAAACGCTACCAAAAACTTAGACTTCCTTCCCACTAAAATACCACTTT
TCTCTTTCAACTTTTTTAAAAAACGGATATGCAACTTTTAGTATTGGTATCAAAATGATT
GTTAGGTCATATTCTATCAATATATTTTTATAAAGAATTGCTTTTATTAACTTTCAATTA
TGTACCTAACCTAAAAAGAAGCCAAGGCAACGAATGTTACCTTGACTTCTAATACATATT
CAACTAACTATATATTCAATCATACGCGCATGCGAGAGTGATTGTTGTACATCTATAATG
CGTTGATTTAAAGAACCTTTATATGGTAAATCAGGTTTGAATAAGTGTTGTATAAATAGA
CCATCTACTAAAACGTCAATGTATGATAATAACTCTCGACGTTCTGTACAATCATTTGCT
AAATATTCATATAAAAATCCAGTCCATACCCAAATTGTCTTTGTATTTCCAAAACGTGCT
CGAAATGCTTTGACAAGATTTAATGTAATATCCAAATTACAAAATGGTTCGCCACCTAAT
AGACTTAGCCCAGATATATAATCATGATCGCAATCATCTAATATTTCTGCTAATATTTCA
TCAGTGTATTTCTCGCCATATCTGAACTTTTGTGAGGCTTTGTTATAACATCCAACACAA
TTAAATGGACATCCTGATACATAAACACTGCATCTTACTCCTTCACCGTCAACAAAGCTA
TTTGATTCTATTTTAGCAATATAACCTTGTCCTTGTTTAATGTCTAAAAGTATCATTCTT
TAGGCGCTTTCATATGTTTTACTCGTGCGCAAATTTCTTTATGACGGCCTTTAATTACTG
GACGTTGAACTGGATTGCCTAGGTAACCACATGTTCGTTTAACGACATCAACTGTTTTAG
GATTATCATTGCCACAGTTCGGGCATTTAAATCCTTTTTCAGTTGCTTCAAAATCTCCAT
CGTAATCACATTCATAACAATGATC
```

LOCUS 41 (HB7)
```
GATCTACATTATATTGCTCAAATAAAGGCGATAATACTTTAGGATTTGGCTTCTCATAGG
CATCCGCTTCGGTAGAAATGATCAAATCGAACAACGAGGTAGCATTGGTATGTGCTAAAA
ATTGTTCTACACCTTTTTTAGTATCACTCGTAACAATACCAAGTTGATAGCCTTTTGCTT
TCAAATCGATAAGTGCTTCTTTAACACCTTCTACCCAATTAATTTCAGGAATACGTTCAT
CTACCAGCTTTTGACTTGTTGACTTGGACCAGTCGGTTGTATCTTGTCCCGTCACATCAT
TAAATGCCTGGATAATTTGTTGTAAAGATCCTGAACCCATCACTGATTTTGGATCAATAG
ATTCTTTAATGACACCGAGTTGTCTTAAAGCAGCTTCTTTATTATGTACTGGGAAAGTCT
CAAGCAATGATTGTACAAATCGTACCCCTATTTTTTCCCAACTTCTATCAAATTCAATTA
```

TABLE 7-continued

```
ACGTACCATCTTTATCAAATAATATCCATTCCATTGATATCAATACTCCTATTTATTTAT
TTCGTATTATGCTGATTCTATGATATTCGTTATCCCCTGAAAATGAACTCGTAGTATTGT
TCTATTTAAATATTGAATTAAATATAATAATAAGTGAAATCCCCTTCAATACTTAACAAT
AAACATTGTAAACTTAATTTATTACCATGCTTCGCTTCATTGAAAGGGATTTTAGTCATG
ATTAACTTTTGCATATTGTTTTCATGATTATATTCAATTTTTATTAATATTTTGGTACAA
CGACTCTCCAACCATTTTTATCTTCTAAAGTACCATTTTGAATACCAGTATAGACGTCGT
ATAATTTTTGAGTAATTTCACCAGTCTCATTATTATTAATAACGATTTCACGATCTTCGT
ATCTCAATGTACCCACAGGTGAAATAACTGCTGCAGTACCACTACCAATACTTCTGTTA
ACTCACCTTTATCATATGATTCGAATAATTCATCGATTGAAACGCGGCGCTCTTCGACTT
CATATCCTAAGTTTTTAGCTAATTCGATAATAGATTTACGTGTAATACCAGGTAAAATAC
TGCCATTCAACTCTGGTGTAATTACTTTGCCATTTTCAACGAAGAAAATGTTCATGCTAC
CAACTTCTTCGATATATTTCTGTTCAACACCATCAAGCCATAATACTTGGTCATAACCTA
ATTTATTTGCATTAGTTTGTGCTAATAAACTTGCCGCATAGTTACCTGCAACTTTTGCAA
AGCCTACACCGCCACGAACAGCACGCACATATTCATCTTCTACATAGATTTTAGTTGGTT
TTAAAGTTTCACCACCATAATATGCACCTGAAGGAGATAAAATAATTAATAATTTATACT
GATGTGATGCACCAACGCCAAGTGCCCCTTCTGTTGCAAAAACAAATGGACGAATATATA
ATGATTGACCTTCCCCTTCAGGAATCCAATCTCTTTCAATATCAACTAATTGTTTTAGCC
CCTCTAACAATTCTGCTTCGTCTACTTGAGGCATTTCTAATCGTGCTAACGAGTTATTAA
GACGCTTAAAATTTTCTTCAGGACGGAAAAGTGCAACTTCCCCATCTCTTTTATATGCTT
TTAATCCTTCGAATACCGATTGACCATAATGAACACCTTGTGCAGCAGGTGAAATTTCAA
TAGGACCATAAGGTACTATCTTCAAATCATGCCATCCTTTATCTGCATCATAATCATAAC
TCAACATATAATCAGTAAAATATTTACCAAAACCTAGTTGAGATGTATTTGGTTTTTGTT
TTAATGTTTCTCGTCGTTCAACTTTAACTGCTTGTGACATGGTGATTGCCTCCTAATAAT
ATTGTATAAGAATTTGTTTAACTTAAATTATAACAATCCATATTTTGCTGTTCAACAAAT
TTTCTAAAAATTCAAAATTAATTAACAGATTTCTAGAAAGACTATATCTTTTAGTATAAA
CGTATTAATTTCACAGAGACAAGTAATCTGTGTTTTACTAATATACTTTACATACAAAAA
ACTCTTTACTTTAAAATGAACTAAGCTCGCGAATTCAATAAGTATAATGAATAATATTAG
AATTCATGCACTAGTTTATTAAAATAAAGAGTAATTTAAAATATCATTCCGTGTATTAAA
GTGAATGGAAATGATTAGTTATTATTTTTAACAGTATCTTTTTGTTCAATAGCTTCTAAC
ATTAATTTAGTCATGCTCGCTAAATCATATTTAGGATC
LOCUS 42 (HB8)
ACGGACTAATATTTCAACTTCCACATTAAAGACACGTTTAATCAACGAATAAATACGTCT
TGCCGTTGTTGCATTTTCCGTTTGAACATTTATAACAAATTGTTGATTTGAAAGACTAAG
TGCACCATTCATTCGAATCAGTGCACTGAGCTCTGCTTTTGCATTCATTTCATCGACGTC
TATTCTAGTTAATTCATTTTTCATTTCTGATGCAAAGCTCATCGTACAGTCATTCCTTTC
TTATTTAAAACATGATTCACCTTAGAACCACTGTCTATTTTCATTTTTTTCACAGCTCTA
TTATCATATCATAATATGATTACGTTCTATATTATTTACGTTTATCACTTGGTACGAAAG
GAATAGTACTAATTAATTCTAAAGCTATGTCATAAATCATTGTCGATAACACTTTAGTAT
TATGTCTTACTAAATGATTTTCAGAAATTTCAACTAAATTGAAGATGTTTTTACATTTA
TGCTTTCTTTTTCAAGTTCAGCCTTATTAACTTCAACTGGTTTAGAATGTTTTTCTTCAT
```

TABLE 7-continued

```
ATTTTTTCAAAACTTGAGCATTGAAAGTTTGTGTACTACAAATGACATAATCAATAAACG

GTTGTCCAGCTTGTCTATGAATCGCATCGATATGATCTTTCACGCTATAACCATCTGTTT

CCCCAGGTTGCGTCATCACATTAGAAACATATAGCTTAGGCGCATCAGAATGAATTAACG

CATCTGAAATACCATTCACACATAAGTTAGAAATAACGCTCGTATATAATGACCCTGGTC

CAAGAACGATTAAATCTGCTTCCCTTAAAGCATCGATTGCTTCTTCCATTGGTTGCACAT

CGTTAGGTTCTAAAAACACACGATCAATTTTTTATGTTTTTTAGGAATATTTGTTTCTC

CAAAAACAATTTCTCCATCTTCCATAACAGCATTTAATTGCACACTTGTATTTGTAGATG

GAATGACTCTACCTTTAATATTTAAAATTTTACTTAATGCTTTAATGGCATGTCCGAAAT

CATTCGTAATATTAGTCATACCTGCGATTAATAAATTACCTAATGAGTGACCGCTAATTT

GATTTTCTTCAAAGCGATACTGAAAAAGTTGGCTTAAAACTGACTCAGAATCACTTAAAG

CTGCAATCACATTTCTGATGTCTCCTGGTGCTGGTATATCCATTTCATCTCTGATTTTCC

CTGTACTCCCACCATTATCAGCAACTGTTACAATCGCCGTAATATCAATTGGGAATTCTC

TTAATCCCCTAGCCATAACTGATAAGCCAGTGCCACCACCGATAAGTACAACTTTTATTT

GTCTCATTTTTTCTCGCCACTTTCAATATGTGCGTCCCTATGATGCACATAAACATTATA

TTCAAATACTTCATTTAGATAATTACCTAGTCGTTCTGCTAATGCTACAGATCGATGTTG

TCCACCCGTACAACCGATGGCAATTACTAATTGAGATTTCCCTTCTTTTTTATACCCGGG

TATCATAAAATCTAACAAATCAGTTAATTTTTCAAAGAAAATCTCCGTCTCTTTCCATTT

CATAACATAATTATAAACGTCTTTATCTAATCCTGTTAAAGGTCTTAAATCTACTACATA

ATATGGATTTGGTAAAAATCGTACATCAAATACTAAATCTGCATCCATCTGAATCCCATG

TTTAAAACCGAAACTTGTGACATTAATTGTAAAAGTTTCAAACTCTTCATCTTCATAGTA

TCGACGAATGCGTTCTTTTAATTCTTTAGGTGATAACTTTGTAGTATCTATAACAAAATT

AGCTATACTTCTAATTTGAGACAAATGCTCTCGCTCATCATTAATTGCATTGATTAACGA

TC

LOCUS 43 (HB10)
GATCAACTCATTGCAAAATACGATTTATAGACATCAAAGAATCAATACATTGTAAAGGGG

ATGTTGCCCATGAAAGAAGTTGGATTTGGCACACTAAACTGGGTTGCCGTTATCATTTAT

CTACTAGCTATGTTGTTCATTGGCGTTTATTTTACCAAGCGCGCGAGCCAAAGTACCAAT

AGTTTCTTTACCGCAAGTGGTCGCTTGCCATCTTGGGTAGTTGGCTTTTCAATTTATGCT

ACTACGTTAAGTGCGATTACATTTATGTCGACACCAGAGAAAGCATTTTTAACAGATTGG

TCATATATCGCTGGTAACATTGCTATCGTCGCAATTATTCCATTACTTATTTATTTCTAT

GTCCCTTTCTTTAAAAAGTTAAAGGTAACATCTGCATATGAATATTTAGAAGCTAGATTT

GGCCCTAGCATACGTGTCATTGGCTCATTATTATTTGTCGTTTACCATTAGGGCGTGTT

GCAATTGTTATCTACTTACCAACATTAGCAATCACATCTGTATCAGACATGAACCCTTAT

ATCGTTGCATCACTCGTTGGTTTACTATGTATTTATATACATTTTTAGGTGGTTTCGAA

GGTGTGGTTTGGAGTGATTTCATTCAAGGCGTCATTTTATTAGGCGGCGCTTTAGTTATT

ATTATTCTAGGTGTTGTGAACATTAAAGGCGGTTTCGGCACTGTCTTTGCAGATGCGATT

GAGCACAAAAAATTAATTAGTGCAGACAATTGGAAACTAAATACTGCGGCAGCTGCCATT

CCAATTATTTTCCTAGGAAATATTTTCAACAACTTGTATCAATACACAGCGAGTCAAGAC

GTCGTGCAGCGTTATCAAGCTTCTGATAGTTTAAAAGAAACAAATAAATCGTTATGGACA

AATGGTATCCTAGCTTTAATTTCAGCACCCTTATTTTATGGTATGGGTACAATGCTGTAT
```

TABLE 7-continued

```
TCATTTTATACACATGAAGCTGTTTTACCAAAAGGCTTCAATACATCATCTGTAGTGCCA
TATTTCATTTTGACTGAGATGCCACCATTTGTAGCAGGATTACTTATTGCAGCCATTTTC
GCCGCTGCACAGTCTACCATTTCATCTAGTTTAAATTCTATATCTGCTTGTATTTCAATC
GACATTAAGCAACGCTTCTTCGGAAAAGGTAGCGAGCGACACGAAGTTAACTTTGCACGT
TTCATTATTATCATTGCAGGTATTTTCGGTTTTGGAATGTCACTATACTTAATTGCTTCT
AATTCAAATGACTTATGGGATTTATTCTTGTTTGTGACTGGATTATTCGGCGTTCCATTG
GCTGGTGTATTTGCAGTTGGTATTTTCACTAAACGTACGAATACATTCGGTGTTATTTGT
GGATTAATATTGGGTATCATCTTTGCTTATGTCTATAATGGTGTTGGCAAAGGTAACTCA
CCTTTCTATGTATCTACCATTTCATTTACAGTTGCTTTTGTCTTTGCTTATATACTTAGC
TTCATTGTCCCTTCAAAACATAAAAAAGATATAACGGGATTAACAATTTTTGAAAAGAT
AAACCATCAACATACATTTCAAAAACGGCTACGAAAAGTAGATTGTTATGATAAAACCC
CGTCACTAAGTTATGATGCGCTGTTGCGCCAACTTGGTGACCGGGTTTAGCTTTGCCATG
AATTTAATTTAGGTACTTCGATTCATTTACAATACTAAGCCAATGATTGATCCTGAAATG
ATTGAAGCTAGAGTTGAACCAAGTAGCAACCTCATTGCAAAGGATGCAACTTTTTCTCCT
TGTTTATCACTAATGCCTTTAATTGAACCTACGATGATACCAACCGTACCAAAATTAGCG
AAGCTTACTAAGTAAACTGAAATGATACCTTGTGTTCGAGCTGATACATCACCCAGGACA
TTTTTAAAATCAAGCATTGCTACAAACTCATTTGTAATTAATTTAGTCGCCATTAAAGAG
CCAGCTGGAACAGCTTCGCTCCATGGAATCCCCATTAAGAATGCGATTGGTGCAAACACA
TAGCCAATAAGCTGTTTAAAGTTCAAACCAACACTACCAAACATGATATTAATTGCTTCC
ATTAATGAAATAAATGCTAACAACATTACGGCTACTACAACAGCGATTTTAAACCCATCC
ATCGCACTATCACCAATCATTTGGAAAAAGGCAACTTTCTTAGGTTTTCCTGTTTTTCCA
TTCAATGTTTTAGTTTCTGTGGATTTCGTTAAGTTATCAATTTCAACATCAGTATCATCA
GATTTATAGGGATTGATTACACTGGCGATGATAAGCGCACTAAAAATATTTAACATTACT
GCTGTAACTACGAACTTGGGTTCAATCATCTGCATATATGAACCTAGCATTGCCATACTA
ACAGCACTCATACCAGACGTCGCAATTGTATATAATTTCGCTCTAGATAATCTTGGAATA
ATATCTTTTATTGTTAAATATACTTCTGGTTGCCCAAACATTGCTGTTGAAATAGCAAAA
TAACTTTCTAAGCGCCCCATTCTAGTTATTTTATTAATAGCGATACCTACATATTTGATA
ATAAATGGTAATACCTTAATATAATTAAAGATGCCTATTAATACAGAAATAAAAACTAAT
GGCAGTAATACGTTTAAAAAGAACGTAAAGCCATTTTTATTTTGTATATCTCCAAAAACA
AAATTTATGCCTGCTTTACTA
LOCUS 44 (HD7)
TCCACTCTCTTCGTTGAATCCAAGATTAACGATTGGCAAACAAATTACAGAAGTAATATT
TCAACATAAACGTGTATCTAAATCTGAAGCAAAGTCGATGACAATAGACATTTTAGAAAA
AGTAGGTATAAAACATGCAACTCGACAATTTGATGCTTATCCACATGAACTTTCTGGTGG
TATGCGTCAACGTGTCATGATAGCAATGGCATTGATTTTAAAGCCACAAATTTTAATCGC
AGATGAACCAACAACGGCATTAGATGCCAGTACACAAAATCAATTACTGCAGTTAATGAA
GTCCCTTTATGAGTACACAGAAACATCTATTATTTTTATCACTCACGATTTAGGCGCTGT
GTATCAATTTTGCGACGATGTGATTGTAATGAAAGATGGAAGTGTCGTTGAAAGTGGCAC
GGTGGAAAGTATTTTTAAATCGCCACAACATACCTATACAAAACGCTTAATAGATGCGAT
TCCTGATATTCATCAAACGCGTCCGCCAAGACCGTTAAACAATGATATTTTATTAAAATT
```

TABLE 7-continued

```
CGATCGCGTGAGCGTGGATTACACATCACCGAGTGGCAGCCTATACCGAGCAGTTAATGA
TATTAACTTGGCTATTAGAAAAGGCGAAACATTAGGCATTGTCGGTGAATCAGGGTCAGG
GAAATCGACATTAGCTAAGACGGTCGTCGGTCTAAAGGAAGTGTCAGAAGGCTTTATTTG
GTATAACGAATTACCATTAAGTTTATTTAAAGATGATGAATTGAAATCTTTACGACAAGA
GATACAAATGATTTTTCAAGATCCATTCGCATCTATTAATCCAAGATTTAAAGTCATTGA
TGTGATTAAACGACCACTAATCATTCATGGGAAAGTCAAAGATAATGATGACATTATTAA
AACTGTCGTATCGTTGTTAGAAAAGGTTGGCCTAGATCAAACTTTCTTATATCGCTATCC
ACACGAATTATCTGGTGGGCAACGTCAGCGTGTAAGTATCGCGAGAGCACTTGCTGTTGA
ACCTAAAGTGATTGTTTGCGACGAGGCAGTGTCCGCTTTAGACGTTTCAATTCAAAAGA
TATCATCGAGTTATTAAAACAATTACAGTTAGACTTCGGCATCACTTATTTATTCATCAC
ACATGACATGGGTGTTATCAATGAAATATGTGATC

LOCUS 45 (HD9)
GATCTGAAGTAGCTCGATTTTAAATAGTTTTCAGCAATGACATCGTCTTTTTCTGTCGGC
GTATTCGGTACCATAACTACTTTTGTACCTTTATTAAACACACCTTTACTGTCAAATACG
ACCTCACCAACACCTTCATGAATTAAAGACATTGGCAATTTCTGAGATAAGACATTCTCA
TCACGGCTACCAGTATAATATCTTTGATC

LOCUS 46 (HE9)
GATCAGATAGATAAAGTATTTTCTTTTTATTATGTTTATCAGAATATGCGCCACCGAAAA
TACCAAATATAATAAATGGAAGTGTTTGACTCATAACCATCATTGATAATTTTAAAGATG
ATTGGTTTGTCAATTCAACAGTAAACCAAATTATTTGTAACGAAAACAGCACAAAACAAC
TCCGACGTAAGAAATTACCAATCAATAAATATGTAAAGTTTCTATTTTTCAAAACTTCTA
AATACAACATATTTATCACCTCTCATAAAAATAATTGAATGCATCCACCAGCTTTTTTAG
ACCTTCTTCTAAACTCTCTTTATCCAAAGCGCAATTAATTCTAATATAATTTAGTCAGTT
AAATATCAATTATTTCGAAATATACATACTACTTGAAACACCATACATAACCCCCAAAAT
GACTACTCAGAGGTTATATTCTACTAATTATGATTATATTAAATATGAAAATATTATCAA
AAAAATCAAATTTATAACAAAAATACACCCCTTAAAGTTAGGTCTTTCAATCCAACTTTT
GGGGTGTATATCATTCTCATCATATTCTAGGTTGTTTTTAACAAACTAAATATAGTGAAT
GCAAATCAACTATTATTTAAATTATGAATTATTTTAATTCTTTCTTCTACGAGCCAATAA
CATTAATCCAGCAATTCCAATTATACTACTAAAGATCAAACCTTTTTGCGTGCTTTCTAA
ACCTGTTTTTGGTAATTCTGCTCGTTTTTCTCTTGATTAGCTACTGATTCTTTAGCAAT
TTTAGATTTTTTAACTTTATCATTTTTATCCATTGAATGAACTGGGCCATTTGGTTTTGC
TCTGTCTTTCGATAATCCTGGATTGTTAGGATTTACTGGGCCACTTGGATGAGTTGGTCT
GCTCGGCTTCTCTGGGTTTTCAGGTCCTTTTGGATCTTTTGGTTTCTCTCCACCGAACTC
TACAATCTTATCTACTGGTTGTTTTGTGATCTCTTCTGTTGGTTGACCCTCGCCAACTTT
TTCACCTGTTAATGGGTTCACTGTGATTGGTGTTGTGATTGTCTTACTTCCTGGTTGTCC
TTCTTGTTTCACTCGCTCTTCACCAGGTTGTAATTTTGGATTAAACTCACGTTTTGTTTC
AAACGGTATCTCTACTGTTTTTGTTTCTGGTGTACCCGTTTTTGGTCCGTGTTTAATCAC
ATCATCCACTGGCTCTTCGATCACTTTTCCTGTGTCTGGATTCTTGATTCCTGGTTTACC
TGGTACTTTTTCCGTTTGATCTGTTGGTAAGTTTGGATCAAAGATATCTTTATGACCTTG
CGGTATTTTCTCGCCACCGAATTCTGTTAATTCATTAACTGGATCTTTTGTGATTTCTTC
TTTCGATTCACCTTTACTAATAATTTCTCCAGTTAATGGATTTTTTAGTGTTGGCGTCGT
```

TABLE 7-continued

```
TATTGTCTTCTCACCTTTTGTCCTTCTCTTGTTACTTTTTCTGTCCCTGGTGCTAAATC
AGGATTAAATTTACGTTCTTTCTCGAATGGAATTTCTTCTTTTTCTACAATCGAGTCTCC
TTTTACAGGTCCATATTTTGTTACGCTATCGACCGGTGGTCTAACTACATCTCCTGTTTC
TGGATTCTTAATTCCTGGTTTACCTGGAACTTCCTCTTTCTCTCCTGTTGGTAACTTCGG
ATCAAATTCGTCTCGATGACCTGGTGTTATCGTTTCTGGTCCGTATTCTGTTAATTCATT
AATCGGATCTTTTGTGATTTCTTCTTTCGATTCACCTTTACTAATAATTTCTCCAGTTAA
TGGATTTTTTAGTGTTGGCGTCGTTATTGTCTTCTCACCTTTTTGTCCTTCTCTTGTTAC
TTTTTCTGTCCCTGGTGCTAAATCAGGATTAAATTTACGTTCTTTCTCGAATGGAATTTC
TTCTTTTTCTACAATCGAGTCTCCTTTTACAGGTCCATATTTTGTTACGCTATCGACCGG
TGGTCTAACTACATCTCCTGTTTCTGGATTCTTAATTCCTGGTTTACCTGGAACTTCCTC
TTTCTCTCCTGTTGGTAACTTCGGATCAAATTCGTCTCGATGACCTGGTGTTATCGTTTC
TGGTCCGTATTCTGTTAATTCATTAATCGGATCTTTTGTGATTTCTTCTTTCGATTCACC
TTTACTAATAATTTCTCCAGTTAATGGATTTTTTAGTGTTGGCGTCGTTATTGTCTTCTC
ACCTTTTGTCCTTCTCTTGTTACTTTTTCTGTCCCTGGTGCTAAATCAGGATTAAATTT
ACGTTCTTTCTTGAATGGAATTTCTTCTTTTTCTACAATCGAGTCTCCTTTTACAGGTCC
ATATTTTGTTACGCTATCGACCGGTGGTCTAACTACGTCTCCTGTTTCTGGATTCTTAAT
TCCTGGTTTACCTGGAACTTCCTCTTTCTCTCCTGTTGGTAACTTCGGATCAAATTCGTC
TCGATGACCTGGTGTTATCGTTTCTGGTCCGTATTCTGTTAATTCATTAATCGGATCTTT
TGTGATTTCTTCTTTCGATTCACCTTTACTAATAATTTCTCCAGTTAATGGATTTTTTAG
TGTTGGCGTCGTTATTGTCTTCTCACCTTTTGTCCTTCTCTTGTTACTTTTTCTGTCCC
TGGTGCTAAATCAGGATTAAATTTACGTTCTTTCTCGAATGGAATCTCTTCTTTTTCTAC
AATCGAGTCTCCTTTTACAGGTCCATATTTTGTTACGCTATCGACCGGTGGTCTAACTAC
ATCTCCTGTTTCTGGATTCTTAATTCCTGGTTTACCTGGAACTTCCTCTTTCTCTCCTGT
TGGTAACTTCGGATCAAATTCGTCTCGATGACCTGGTGTTATCGTTTCTGGTCCGTATTC
TGTTAATTCATTAATCGGATC
LOCUS 47 HF6
GATCCAATTGAATTTTTCTCATTTACAACATAATCTGGATATTGAATGTTAGCAGTTGTT
TTTGTTGTAGTATTACCTATCGTAACATTAAACTCAACATCGTTTTTACTAACAGGAATT
GTATCAGCATCCATATAAATTGAATAATTAATTCCCATTTGTACAGAATTAAATCGATCA
ACATAATCTGTAAATGTATATGTAATTAAATTATTTGCAGTATCATGTTTTGCAGTCGCA
ATTGTTTCACCATTATTTGGATCTTTAATATCACCAATATTTTTAATATCTTCCGGATTC
AATCCATATACTTGTACTGTATCTGAGTATTTAATTGTGAAATAATCACCTGATTTAACT
TTGTCATCAACTGTAATTTGTGATTTTAATGATAAATAATCTTGGGCTGGTACGATTTTA
TTGTTTTTATCTGCATCAACGACAGTTAATGTTGTATTTGATGTGATTAAATCATTAACA
TTTTTAGCCTCTGTTGATGATGGCTGTACTGCTGCTATACGCATTCTTGTATTCAAACGT
TTAGGTGCTGTACTTTTTGGCAAAATGATATCTGCATTATTTTCATTATTTGAATTACTA
TTGTTATCAACAAGAGTTTCATCATTACTCTTGATAGCATCACTTTTAACATTTAATGTA
GTTGATTCAGTTTTGGCATCTACCTTTTTGTTTTCCTCATTAGTTGGTTGAACATTTACC
ACTGATTTATTCTCTTGCAAATCAGGTTGTAACGCTTCTTGATTACTTATAGTTTGTTTA
GTGTTTAAATCTTCATTCGTAGATTTTGGTGAAGCTTGCTCATCTGATTTGGCAGTTGAA
```

TABLE 7-continued

```
ACTTCAACTTTATTTCCAGTGGTAGATTGTACACTTTCTTTTTCTATTAATTTATTCCCA
TTTGAAGTCGTTTCATTACCTTGAGATGATACCATTTCTTTTTGATTATCATTTTTAGTA
TTGTCTTCTTGATTTAGTTGCTGCATATCAACTTTATCACTCGATTGATTATCACTTGCT
GAAGTTGTCGCTTCGTTCAATTCTTTATTAGTACTTTCTGCAGCCTTTGCTTCTTGGTTC
CCCAGACCAAAAATTAATGTTGTACCTACTAAAATTGATGCTGTTCCCACTGTGTACTTT
CTAATCGAAAATTTATTTAATCGATTGGATACCATGCCTTTCCTTGTTATTGCCGTTTTA
TTTTCTCTGTTTAGCATTAGATTACTCCTAATTCATCAAATTTTTAAATAATACAATTGT
TTTAAATACAAAAATGTATATCAATATAGTATTACATTTTTAGATAAAGCACAATACTTT
AATTATTTTCTTTATCGTAAAACGTTATTTAACATTTGTGTTTAAATAAAAGTTTTTAT
GAGTTTTGTAATCTTTATTTAATCATCATAAAAAATAGTATTATTTGCCCTTGAAATTAA
TATCTTAGCTTTTCTAATTCATAGACAATTACATTTCTGTAACAAATTAAATTGTATCTA
TTCCTTAAAGATTTTTTGTTTTATATCTGGGAATTTCTAAACAGAAAAAACCAGGCCACA
TGGACCTGGTTAAGTTAATCATATTATTTATTTTGTTTTTTACGACGACCGAATAACAAT
AATGATCCTAATGCCGCGAATAATCCACCGAATAATGTGCCATTATTTGAATTATTATTT
TCACTACCTGTTTCTGGTAATGCTTTAGCTGTTTTATGCTGATCTTTAACCGTACTCATT
GGTTTAGCCGGAGTATGTTTACCTGCATCTGAATCTGAATCGCTATCTGAATCTGAGTCG
TTGTCTGAGTCCGAATCGCTATCTGAATCTGAGTCGCTGTCTGAATCTGAATCGCTATCC
GAGTCTGAGTCGCTATCTGAGTCTGAGTCGCTATCTGAATCTGAATCGCTGTCTGAGTCT
GAATCGCTATCTGAGTCTGAATCGCTGTCCGAATCTGAGTCGCTATCTGAATCTGAATCG
CTATCTGAATCTGAGTCGTTGTCTGAGTCCGAATCGCTATCTGAATCTGAGTCGCTATCT
GAGTCTGAGTCGCTATCTGAATCTGAGTCGCTGTCTGAATCTGAATCACTGTCTGAGTCT
GAGTCGCTGTCTGAGTCTGAATCGCTGTCAGAATCTGAGTCGCTATCTGAGTCTGAATCT
GAATCACTGTCTGAGTCCGAATCGCTATCTGAATCTGAATCGCTATCTGAGTCTGAGTCG
CTATCCGAATCTGAGTCGCTATCTGAGTCTGAGTCGCTATCCGAGTCTGAATCGCTGTCT
GAGTCTGAGTCGCTGTCTGAATCTGAATCGCTATCTGAGTCTGAGTCGCTGTCTGAATCG
GAGTCTGAGTCGCTGTCTGAATCTGAATCGCTATCTGAGTCTGAGTCGCTGTCTGAATCG
GAATCTGAGTCGCTATCTGATGTTTCTT
LOCUS 49 (A) B13
TCTTTATTCGAACTATTAGATTCACTTTGACCAGTAGTCGTTCCATCAGATCCTTTGTCA
CTACCTGAAGCAGAATTTTTATCATCTTTACCTGGTGCATTAGCACCTGCTACATCAGTT
GGTCCATTAAATTTATATGTAATGTTGTAATGATGGTCATATTTGAATGGCTTTCCATTT
ACTTTTTCATCGATATAAACGTCAATTTTTCCATCTATTTTACCGTTCAACTTACTTACT
TCAAATTCAGAAGTGCGTTCATCTTTGGCAGTGTTTTTACTAATAATATTTTCTTTATGT
CCTTCGATACTCATTCCAGTAATCCAATGACTGTGGTTGACAGTTATTTGAACATACAAT
TTACCATTTTTCTTAATGTACTTTGCCGGTTTATTAAAATAGTCATTAGCAATTGACGTG
TCATTGGTATTGTATTTGTAAACCTCATAATTCAAAGTACCGCTATCTGCGGCATTTGCA
GAATTACTGAATGTCGCGATGATGATAATTAACGCTAAAATCGTTGTATTAAAAACTTTT
AAAATATTTTTCAAAACATAATCCTCCTTTTTATGATTGCTTTTAAGTCTTTAGTAAAAT
CATAAATAATAATGATTATCATTGTCAATATTTATTTTATAATCAATTTATTATTGTTAT
ACGAAAATAGATGTGCTAGTATAATTGATAACCATTATCAATTGCAATGGTTAATCATCT
```

TABLE 7-continued

```
CATATAACAACACATAATTTGTATCCTTAGGAGGAAAACAACATGACAAAACATTATTTA

AACAGTAAGTATCAATCAGAACAACGTTCATCAGCTATGAAAAAGATTACAATGGGTACA

GCATCTATCATTTTAGGTTCCCTTGTATACATAGGCGCAGACAGCCAACAAGTCAATGCG

GCAACAGAAGCTACGAACGCAACTAATAATCAAAGCACACAAGTTTCTCAAGCAACATCA

CAACCAATTAATTTCCAAGTGCAAAAAGATGGCTCTTCAGAGAAGTCACACATGGATGAC

TATATGCAACACCCTGGTAAAGTAATTAAACAAAATAATAAATATTATTTCCAAACCGTG

TTAAACAATGCATCATTCTGGAAAGAATACAAATTTTACAATGCAAACAATCAAGAATTA

GCAACAACTGTTGTTAACGATAATAAAAAAGCGGATACTAGAACAATCAATGTTGCAGTT

GAACCTGGATATAAGAGCTTAACTACTAAAGTACATATTGTCGTGCCACAAATTAATTAC

AATCATAGATATACTACGCATTTGGAATTTGAAAAAGCAATTCCTACATTAGCTGACGCA

GCAAAACCAAACAATGTTAAACCGGTTCAACCAAAACCAGCTCAACCTAAAACACCTACT

GAGCAAACTAAACCAGTTCAACCTAAACTTGAAAAAGTTAAACCTACTGTAACTACAACA

AGCAAAGTTGAAGACAATCACTCTACTAAAGTTGTAAGTACTGACACAACAAAAGATCAA

LOCUS 49 (B) K16
AGATCAAACTAAAACACAAACTGCTCATACAGTTAAAACAGCACAAACTGCTCAAGAACA

AAATAAAGTTCAAACACCTGTTAAAGATGTTGCAACAGCGAAATCTGAAAGCAACAATCA

AGCTGTAAGTGATAATAAATCACAACAAACTAACAAAGTTACAAAACATAACGAAACGCC

TAAACAAGCATCTAAAGCTAAAGAATTACCAAAAACTGGTTTAACTTCAGTTGATAACTT

TATTAGCACAGTTGCCTTCGCAACACTTGCCCTTTTAGGTTCATTATCTTTATTACTTTT

CAAAAGAAAAGAATCTAAATAAATCATCGTCACACTCATAACTTAATATATTTTTTATTT

TAAATTTTATTTAACCTATGTCATAGATATTTCATAATCTATAACATAGGTTATTTTTTT

TATAAAATAACGTTGCAATTAACTAACATTTCAATGTACAATACAAGTAATCAATTGATA

ATGATTATCAGTTGATAATATACAATTAGGAGTTGTTTCTACAACATGAACAAACAGCAA

AAAGAATTTAAATCATTTTATTCAATTAGAAAGTCATCACTAGGCGTTGCATCTGTAGCA

ATTAGTACTTTTATTATTAATGTCAAATGGCGAAGCACAAGCAGCAGCTGAAGAAACA

GGTGGTACAAATACAGAAGCACAACCAAAAACTGAAGCAGTTGCAAGTCCAACAACAACA

TCTGAAAAAGCTCCAGAAACTAAACCAGTAGCTAATGCTGTCTCAGTATCTAATAAAGAA

GTTGAGGCCCCTACTTCTGAAACAAAAGAAGCTAAAGAAGTTAAAGAAGTTAAAGCCCCT

AAGGAAACAAAAGAAGTTAAACCAGCAGCAAAAGCCACTAACAATACATATCCTATTTTG

AATCAGGAACTTAGAGAAGCGATTAAAAACCCTGCAATAAAAGACAAAGATCATAGCGCA

CCAAACTCTCGTCCAATTGATTTTGAAATGAAAAAGAAAGATGGAACTCAACAGTTTTAT

CATTATGCAAGTTCTGTTAAACCTGCTAGAGTTATTTTCACTGATTCAAAACCAGAAATT

GAATTAGGATTACAATCAGGTCAATTTTGGAGAAAATTTGAAGTTTATGAAGGTGACAAA

AAGTTGCCAATTAAATTAGTATCATACGATACTGTTAAAGATTATGCTTACATTCGCTTC

TCTGTATCAAACGGAACAAAAGCTGTTAAAATTGTTAGTTCAACACACTTCAATAACAAA

GAAGAAAATACGATTACACATTAATGGAATTCGCACAACCAATTTATAACAGTGCAGAT

AAATTCAAAACTGAAGAAGATTATAAAGCTGAAAAATTATTAGCGCCATATAAAAAAGCG

AAAACACTAGAAAGACAAGTTTATGAATTAAATAAAATTCAAGATAAACTTCCTGAAAAA

TTAAAGGCTGAGTACAAGAAGAAATTAGAGGATACAAAGAAAGCTTTAGATGAGCAAGTG

AAATCAGCTATTACTGAATTCCAAAATGTACAACCAACAAATGAAAAAATGACTGATTTA
```

TABLE 7-continued

```
CAAGATACAAAATATGTTGTTTATGAAAGTGTTGAGAATAACGAATCTATGATGGATACT

TTTGTTAAACACCCTATTAAAACAGGTATGCTTAACGGCAAAAAATATATGGTCATGGAA

ACTACTAATGACGATTACTGGAAAGATTTCATGGTTGAAGGTCAACGTGTTAGAACTATA

AGCAAAGATGCTAAAAATAATACTAGAACAATTATTTTCCCATATGTTGAAGGTAAAACT

CTATATGATGCTATCGTTAAAGTTCACGTAAAAACGATTGATTATGATGGACAATACCAT

GTCAGAATCGTTGATAAAGAAGCATTTACAAAAGCCAATACCGATAAATCTAACAAAAAA

GAACAACAAGATAACTCAGCTAAGAAGGAAGCTACTCCAGCTACGCCTAGCAAACCAACA

CCATCACCTGTTGAAAAAGAATCACAAAAACAAGACAGCCAAAAAGATGACAATAAACAA

TTACCAAGTGTTGAAAAAGAAAATGACGCATCTAGTGAGTCAGGTAAAGACAAAACGCCT

GCTACAAAACCAACTAAAGGTGAAGTAGAATCAAGTAGTACAACTCCAACTAAGGTAGTA

TCTACGACTCAAAATGTTGCAAAACCAACAACTGCTTCATCAAAAACAACAAAAGATGTT

GTTCAAACTTCAGCAGGTTCTAGCGAAGCAAAAGATAGTGCTCCATTACAAAAAGCAAAC

ATTAAAAACACAAATGATGGACACACTCAAAGCCAAAACAATAAAAATACACAAGAAAAT

AAAGCAAAATCATTACCACAAACTGGTGAAGAATCAAATAAAGATATGACATTACCATTA

ATGGCATTATTAGCTTTAAGTAGCATCGTTGCATTCGTATTACCTAGAAAACGTAAAAAC

TAATAAATCGTCTTTATATTTAATTATTAAATTAACAAATTTTAATTGGCGGATGAGGTA

TCCAGTTACCTCGTTCGCCAATTATTTTTCGCAATATAAAAAGTCCCACTTAAAACAATC

ATTTTAAGCGGGACTTTTTATATTGAGTAACTAAAATTATTTAGCTGCTACTTCTTCGCC

ATTGTAAGAACCACAGTTTTTACATACACGGTGTGATAATTTGTATTCGACCACAGTTTG

GGCATTCAGTCATACCTGGTACTGAAATTTTGAAATGCGTACGACGTTTGTTTTTTCTAG

TTTTAGAAGTTCTTCTTTTTGGTACTGCCATGATATATCCTCCTTAGATTATAAACGAAA

AATACTAAATGTTAGTTTAATTAACAACATTATATCATTAATTAAACTACTTATTGCTCT

TTATCATATAATTGTTGTAATTTTTGAAGCCTTGGATCAACTTGTCGTGATTCTGAATCA

TCTTGTTGCTTGCTGTTTAGCAAGCTCATCTAATTGATCCTCATCGATTACTTCCCAACC

ATTACCTACTGTCAACATTTGGTCACTTTGCTCTGAATAAGCTCTCATTGGTTTCTCAAT

AATAACTATATCCTCGACAATATCCTGAAGATTAACCATACCATCTTTAATAATGTGATA

GTGTTCATCTACATCATCTTGATCATCGTTATACTGATTGTACCCTTCTAAATC

LOCUS 50 (A) GB2
GATCCAGCGGCTGCAGCGGTAGGAAACGGTGGTGCACCAGTTGCAATTACAGCGCCATAT

ACGCCAACAACTGATCCTAATGCCAATAATGCAGGACAAAATGCACCTAACGAAGTGCTG

TCATTTGATGACAATGGTATTAGACCAAGTACCAACCGTTCTGTGCCAACAGTAAACGTT

GTTAATAACTTGCCGGGCTTCACACTAATCAATGGTGGCAAAGTAGGGGTGTTTAGTCAT

GCAATGGTAAGAACGAGCATGTTTGATTCAGGAGATAATAAGAACTATCAAGCAGAAGGA

AATGTAATTGCATTAGGTCGTATACATGGAACTGATACGAATGACCATGGCGATTTTAAT

GGTATCGAGAAAGCATTAACAGTAAATCCGAATTCTGAATTAATCTTTGAATTTAATACA

ATGACTACTAAAAACGGTCAAGGCGCAACAAATGTTATTATCAAAAATGCTGATACTAAT

GATACGATTGCTGAAAAGACTGTTGAAGGCGGTCCAACTTTGCGTTTATTTAAAGTACCT

GATAATGTGAGAAATCTCAAAATTCAATTTGTACCTAAAAATGACGCAATAACAGATGCG

CGTGGCATTTATCAACTAAAAGATGGTTACAAATACTATAGCTTTGTTGACTCTATCGGA

CTTCATTCTGGGTCACATGTTTTTGTTGAAAGACGAACAATGGATCCAACAGCAACAAAT
```

TABLE 7-continued

```
AATAAAGAGTTTACTGTAACAACATCATTAAAGAATAATGGTAATTCTGGTGCTTCTCTA
GATACAAATGACTTTGTATATCAAGTTCAATTACCTGAAGGTGTTGAATATGTGAACAAT
TCATTGACTAAAGATTTTCCAAGTAACAATTCAGGCGTTGATGTTAATGATATGAATGTT
ACATATGATGCAGCAAATCGTGTGATAACAATTAAAAGTACTGGAGGAGGTACAGCAAAC
TCTCCGGCACGACTTATGCCTGATAAAATACTCGATTTAAGATATAAATTACGTGTAAAT
AATGTGCCGACACCAAGAACAGTAACATTTAACGAGACATTAACGTATAAAACATATACA
CAAGATTTCATTAATTCAGCTGCAGAAAGTCATACTGTAAGTACAAATCCATATACTATC
GATATCATCATGAATAAAGATGCATTACAAGCCGAAGTTGACAGACGTATTCAACAAGCT
GATTATACATTTGCGTCATTAGATATCTTTAATGGTCTGAAACGACGCGCACAAACGATT
TTAGATGAAAATCGTAACAATGTACCATTAAATAAAAGAGTTTCTCAAGCATATATTGAT
TCATTAACTAATCAAATGCAACATACGTTAATTCGAAGTGTTGATGCTGAAAATGCAGTT
AATAAAAAGTTGACCAAATGGAAGATTTAGTTAATCAAAATGATGAATTGACAGATGAA
GAAAAACAAGCAGCAATACAAGTTATCGAGGAACATAAAAATGAAATAATTGGTAATATT
GGTGACCAAACGACTGATGATGGCGTTACTAGAATCAAAGATCAAGGTATACAGACCTTA
AGTGGGGATACTGCAACACCGGTTGTTAAACCAAATGCTAAAAAAGCAATACGTGATAAA
GCAACGAAACAAAGGGAAATTATCAATGCAACACCAGATGCTACTGAAGACGAGATTCAA
GATGCACTAAATCAATTAGCTACGGATGAAACAGATGCTATTGATAATGTTACGAATGCT
ACTACAAATGCTGACGTTGAAACAGCTAAAAATAATGGCATCAATACTATTGGAGCAGTT
GTTCCTCAAGTAACTCATAAAAAAGCTGCAAGAGATGCAATTAACCAAGCAACAGCAACG
AAAAGACAACAAATAAATAGTAATAGAGAAGCAACTCAGGAAGAGAAAAATGCAGCATTG
AACGAATTAACTCAAGCAACCAACCATGCTTTAGAACAAATCAATCAAGCAACAACAAAT
GCTAATGTTGATAACGCCAAAGGAGATGGTCTAAATGCCATTAATCCAATTGCTCCTGTA
ACTGTTGTTAAGCAAGCTGCAAGGGATGCCGTATCACATGATGCACAACAACATATCGCA
GAGATCAATGCTAATCCTGATGCGACTCAAGAAGAAAGACAAGCAGCAATTGACAAAGTG
AATGCTGCTGTAACTGCAGCAAACACAAACATTTTAAACGCTAATACCAATGCTGATGTT
GAACAAGTAAAGACAAATGCGATTCAAGGAATACAAGCAATTACACCAGCTACAAAAGTA
AAAACAGATGCAAAAAATGCCATCGATAAAAGTGCGGAAACGCAACATAATACGATATTT
AATAATAATGATGCGACGCTCGAAGAACAACAAGCAGCACAACAATTACTTGATCAAGCT
GTAGCCACAGCGAAGCAAAATATTAATGCAGCAGATACGAATCAAGAAGTTGCACAAGCA
AAAGATCAGGGCACACAAAATATAGTAGTGATTCAACCGGCAACACAAGTTAAAACGGAT
ACTCGCAATGTTGTAAATGATAAAGCGCGAGAGGCGATAACAAATATCAATGCTACAACT
GGCGCGACTCGAGAAGAGAAACAAGAAGCGATAAATCGTGTCAATACACTTAAAAATAGA
GCATTAACTGATATTGGTGTGACGTCTACTACTGCGATGGTCAATAGTATTAGAGACGAT
GCAGTCAATCAAATCGGCGCAGTTCAACCGCATGTAACGAAGAAACAAACTGCTACAGGT
GTATTAAATGATTTAGCAACTGCTAAAAAGCAAGAAATTAATCAAAACACAAATGCAACA
ACTGAAGAAAAGCAAGTGGCTTTAAATCAAGTGGATC
LOCUS 50 (B) G10
GATCCAGCGGCTGCAGCGGTAGGAAACGGTGGTGCACCCAGTTGCAATTACAGCGCCATAT
ACGCCAACAACTGATCCTAATGCCAATAATGCAGGACAAAATGCACCTAACGAAGTGCTG
TCATTTGATGACAATGGTATTAGACCAAGTACCAACCGTTCTGTGCCAACAGTAAACGTT
```

TABLE 7-continued

```
GTTAATAACTTGCCGGGCTTCACACTAATCAATGGTGGCAAAGTAGGGGTGTTTAGTCAT
GCAATGGTAAGAACGAGCATGTTTGATTCAGGAGATAATAAGAACTATCAAGCACAAGGA
AATGTAATTGCATTAGGTCGTATACATGGAACTGATACGAATGACCATGGCGATTTTAAT
GGTATCGAGAAAGCATTAACAGTAAATCCGAATTCTGAATTAATCTTTGAATTTAATACA
ATGACTACTAAAAACGGTCAAGGCGCAACAAATGTTATTATCAAAAATGCTGATACTAAT
GATACGATTGCTGAAAAGACTGTTGAAGGCGGTCCAACTTTGCGTTTATTTAAAGTACCT
GATAATGTGAGAAATCTCAAAATTCAATTTGTACCTAAAAATGACGCAATAACAGATGCG
CGTGGCATTTATCAACTAAAAGATGGTTACAAATACTATAGCTTTGTTGACTCTATCGGA
CTTCATTCTGGGTCACATGTTTTTGTTGAAAGACGAACAATGGATCCAACAGCAACAAAT
AATAAAGAGTTTACTGTAACAACATCATTAAAGAATAATGGTAATTCTGGTGCTTCTCTA
GATACAAATGACTTTGTATATCAAGTTCAATTACCTGAAGGTGTTGAATATGTGAACAAT
TCATTGACTAAAGATTTTCCAAGTAACAATTCAGGCGTTGATGTTAATGATATGAATGTT
ACATATGATGCAGCAAATCGTGTGATAACAATTAAAAGTACTGGAGGAGGTACAGCAAAC
TCTCCGGCACGACTTATGCCTGATAAAATACTCGATTTAAGATATAAATTACGTGTAAAT
AATGTGCCGACACCAAGAACAGTAACATTTAACGAGACATTAACGTATAAAACATATACA
CAAGATTTCATTAATTCAGCTGCAGAAAGTCATACTGTAAGTACAAATCCATATACTATC
GATATCATCATGAATAAAGATGCATTACAAGCCGAAGTTGACAGACGTATTCAACAAGCT
GATTATACATTTGCGTCATTAGATATCTTTAATGGTCTGAAACGACGCGCACAAACGATT
TTAGATGAAAATCGTAACAATGTACCATTAAATAAAAGAGTTTCTCAAGCATATATTGAT
TCATTAACTAATCAAATGCAACATACGTTAATTCGAAGTGTTGATGCTGAAAATGCAGTT
AATAAAAAAGTTGACCAAATGGAAGATTTAGTTAATCAAAATGATGAATTGACAGATGAA
GAAAAACAAGCAGCAATACAAGTTATCGAGGAACATAAAAATGAAATAATTGGTAATATT
GGTGACCAAACGACTGATGATGGCGTTACTAGAATCAAAGATCAAGGTATACAGACCTTA
AGTGGGGATACTGCAACACCGGTTGTTAAACCAAATGCTAAAAAAGCAATACGTGATAAA
GCAACGAAACAAAGGGAAATTATCAATGCAACACCAGATGCTACTGAAGACGAGATTCAA
GATGCACTAAATCAATTAGCTACGGATGAAACAGATGCTATTGATAATGTTACGAATGCT
ACTACAAATGCTGACGTTGAAACAGCTAAAAATAATGGCATCAATACTATTGGAGCAGTT
GTTCCTCAAGTAACTCATAAAAAAGCTGCAAGAGATGCAATTAACCAAGCAACAGCAACG
AAAAGACAACAAATAAATAGTAATAGAGAAGCAACTCAGGAAGAGAAAAATGCAGCATTG
AACGAATTAACTCAAGCAACCAACCATGCTTTAGAACAAATCAATCAAGCAACAACAAAT
GCTAATGTTGATAACGCCAAAGGAGATGGTCTAAATGCCATTAATCCAATTGCTCCTGTA
ACTGTTGTTAAGCAAGCTGCAAGGGATGCCGTATCACATGATGCACAACAACATATCGCA
GAGATCAATGCTAATCCTGATGCGACTCAAGAAGAAAGACAAGCAGCAATTGACAAAGTG
AATGCTGCTGTAACTGCAGCAAACACAAACATTTTAAACGCTAATACCAATGCTGATGTT
GAACAAGTAAAGACAAATGCGATTCAAGGAATACAAGCAATTACACCAGCTACAAAAGTA
AAAACAGATGCAAAAAATGCCATCGATAAAGTGCGGAAACGCAACATAATACGATATTT
AATAATAATGATGCGACGTCCGAAGAACAACAAGCAGCACAACAATTACTTGATCAAGCT
GTAGCCACAGCGAAGCAAAATATTAATGCAGCAGATACGAATCAAGAAGTTGCACAAGCA
AAAGATCAGGGCACACAAAATATAGTAGTGATTCAACCGGCAACACAAGTTAAAACGGAT
ACTCGCAATGTTGTAAATGATAAAGCGCGAGAGGCGATAACAAATATCAATGCTACAACT
```

TABLE 7-continued

```
GGCGCGACTCGAGAAGAGAAACAAGAAGCGATAAATCGTGTCAATACACTTAAAAATAGA
GCATTAACTGATATTGGTGTGACGTCTACTACTGCGATGGTCAATAGTATTAGAGACGAT
GCAGTCAATCAAATCGGCGCAGTTCAACCGCATGTAACGAAGAAACAAACTGCTACAGGT
GTATTAAATGATTTAGCAACTGCTAAAAAGCAAGAAATTAATCAAAACACAAATGCAACA
ACTGAAGAAAAGCAAGTGGCTTTAAATCAAGTGGATC

LOCUS 51 (GC8)
GATCCACTGATGCTAGACGAATCACTTGTAGACATTGAGTCGCTTTCTGATGCACTGATG
CTCATAGAGTCAAATTGACTATTACTTGTTGAGCTTGACTGCGAATCGCTCACACTTGTT
GACGTTGATTCTGATCCACTCATACTTTGCGAGCTACTCAATGATTTTGAATCACTTAAT
GAATCCGAAGTGCTAAGACTTGTGGAACCACTTAAAGATATTGATCCACTTAATGAGTCG
GAGTCACTTGTACTAGTAGAATCACTCATTGATATTGAATCACTTAGCGAGGTAGACTCG
CTTACGCTTTCTGAACCACTTAATGATGTTGAGGTACTCAATGAACCAGATGTACTTGTT
GAAGTCGAACCACTTGTTGATTTTGAATCACTTAATGAATCAGATTCACTCACGCTTTCT
GAACTTCTTAGTGACGTCGATACACTTAATGATGACGAATCGCTTGTGCTTACTGAATCG
CTCATCGATTGTGAGCAACTCAATGAACTTGACTCGCTTACACTTTCTGATTTTCTTAAT
GACGTTGAGACGCTCAATGAGCCAGAATCACTGACACTTGTTGAGCCACTCATCGATTTA
GAGTCACTTTCAGAATTAGATTCACTTACACTTTCTGAATCATTTACAGATTCTGACATA
CTTTGTGAATCAGATATGCTTGCGCTCATTACTTCACTAGCCGATGTTGATGTACTTGTC
GAATCACTTAACGATATAGACACACTCATCGAACCAGATGTACTCGCACTTGTTGAGTCT
GATGTTGAATCACTAACACTATCAGATAATGACGTTGAATCACTCATACTTGTTGATGTA
CTTGTCGAAAGCGACATACTTTGTGAATCACTAGTACTTGTACGCATCGAAGTACTAGTT
GAAGCTGATGTACTACGAGAGTCACTTGTTGATGTTGATGTACTTGCTGATCCTGATGCA
CTTGTACTTCTTGATGTGCTTTGTGAATCGCTTAATGATGTTGATGTTGAATCGGATTCA
CTTGTACTTTCTGATGTTGAGCCAGACTCTGATGTACTTACCGATGTAGATAAACTTGCA
ATGGTCGACATGCGGTTTGAAGTTGATGTACTTAGCGAATCACTTAATGATGCTGATGTG
CTTTGTGAATCGGATTCA

LOCUS 52 (E1)
CAGGATTCGTTTTATCTAACTCTTCCCCAAAAGCTGATAAGTGTTGTGTAGTTTGTGTTG
TCATTACAGTAACTAAGATTGCTGTACCTATAGAGCCTGCTAATTGACGCATCGTATTTA
AGAAAGCATTACCATGAGAGGCAAGTCGTCCCGGTAACGCATTAATAGCTGCAGTTACCA
TTGGCATCATTATAAATGCCATACCAAATGAACGAAGTACATAGATACCCATGATTGTCA
TATATGGTGTATCCATATTTAATTTAGTTAATTCCCATGTTGCATAAGTCATTACAGCAA
TACCAAAGATAGCTAATGGTTTTAAACCAATAGTATCTAACAATTTACCTGCAAATGGTC
CTAGTAGACCCATAATTAGAGAACCAGGTAATAATAACAATCCGGAATCTAATGCTGAGA
ATCCGCGTAAATTTTGTAAATAAATCGGTAATAAAATCATACCACCATATAAACTTAACA
TTACAACCATATTAATAATTGTTGTTAATGTAAATGTTGGGAATTTCAATACTTCTAAAT
TCAACATTGGTGATTTCATTCTTAATTCTCTAATAACGAATAGAATAATAAAGATAATAC
CAATCGCAAACATTGTTTCTATCTCTACTGAACCCCAACCTTTGTTGCCAGCTTCTGAGA
AACCATATAACAAACCACCAAAACCAATCGTACTAAAAATGATACCTGGGATATCAGCTT
TAGGGTTTGTTGTATATTGATATAACTTAAACCATACAAAACCAATTAAAATAGCGATAA
TCCCGATAATGAACATACCGTAAAACATCACATTCCAATGGTAATTTTGTACAATATAAC
```

TABLE 7-continued

```
CTGATAATGTTGGACCAATTGCAGGTGCTAAAATCATTGCGATACCCATTGTACCCATGG

CAGCACCACGTTTTTCAGGTGGATAAATTGTAATAATAACAATTGAACCTAATGGCATTA

GTACACCTGCACCAATGGCTTGTAATACACGTCCAACCATCATGATTGGGAAATTCATTG

AAATCGCACAGATTAATGAACCAATTGTAAAGAGTACTAACGCAACTAAAAATAATTTTC

GATATGAATATTTATTAAATAGATACGCCGTAATTGGTATTAAAATACCGTTTACTAACA

TGAATCCCGTCATCAACCATTGCCCTGTTGACGCAGAAATATTAAATTCCGTATTAATTT

TTGGTAAAGCAACATTTAATAATGTTTGGTTTAAAATCGCAATAAACATACCGAATAATA

ATGCCGCTAATATTTTACCGCGTGAAACACCTTCACCAAAAATAAAGTTTTTATGTTCTT

TTTTTATTTTTTCATTCACTTTATATTCTTCTGATTCAGGATTTTTAGCAGCAACTGCTT

CCTCATCCTTATTATTAGTGAATGCTTCTTGATCTTTCTCAGACCCCTTTGTGTAACCAT

TTAGACTAACTTGGCTATGATCATCTTGATTGTCAACACGCAACTCTTCATGCGTCATAC

GTTGTGTCGATTGATCAGTTGTTTTGTCTAAATCACTAGCTTTAAATTTAGATTGATTTG

ATTGACGTGTCGTAAATTGTTGTTCCTTTTGTTGGCGTTTGCCTTTTTTTCTTGATCTTA

TTAAAAATAAATTGATAACCCCAACAATAATGAGCGCTAAAATAATGTAGCTAATAATGA

AGGTCGTAGTCATTTAATGACCCCCTTAATTTTTATGGATTTTTACTTCAGCGTTCATTC

CAGGAACAACTTGTTTAGACGGTTCTGATTCTAGAGTGATTTTAACAGGTATTACTTGAG

AAACTTTAGTGTAGTTACCATCACTATTTGATGATGGCATTAATGAAAAGCTTGCAGCAG

TTGCTTTTCCAATACTATCAACTTTACCTTTAATAGAAGCTTTTTGACCGTCAATAGTCA

CATCAACATCTTTACCTACTTCAACATCTTTAATATCTTTTTCGTCAATATTTGCTGTTA

CATATAAATCATCTAAATTGTATGCATAAGCGATTGGGTTACCAGCTTGCACCATTGAAC

CTTCCATACCATCTAATTTCGCAATTGTACCTTTTTGAGGCATT
```

LOCUS 53 (E20)
```
CATACTTCTATGTCTGGTTCTTGATTTAATAGCTCATAAATATCAAATGCTGGTGATTCT

CTTATATCATCAACATCACCTTTATAAGTTAAACCAAATACTGTGACTTTATTCCCGCTC

AACACTTTGATGATTTGCTTCGTTGTATCAACAACATAGGCCGGCATTGAATTATTAATT

TCACGTCCAGTTTGAATTAACTTTGCATTTTCAGGGTCTTTAGCAATAATAAAGTACGGA

TCAACAGCTAAACAATGACCGCCTACACCTGGACCAGGCTGATGGATGTTAACACGCGGA

TGTTTGTTTGCCATTTCAATCACATCTAATACATTAATATTTAAGTTATTGCAAATTTTT

GTTAATTCATTAGCTAAAGCAATGTTCACGTCTCTATATGTGTTTTCCATTAGCTTACTC

ATTTCAGCAGTACGTGCATCTGTTTCAATCATTTCTCCCTGAACGAATGTGCGATAGACA

CGTTTACCCGCTTCAATACAAGCTTCAGTCACACCGCCAATGATACGATTGTTATGAACT

AATTCTTCTAAAATTTTTCCTGGCAGTACACGTTCTGGACAATGCACTAAATAAATATCT

TCACCTATTGTAAACCCTAAATTTTCAATGACTGGTTTTACAAAATCATCCATCGTTTTA

GGCGCAATTGTCGACTCTACAATAATGGTATTTCCTTTTTCTAAAAATGATAAAATACTA

TCTAATGCACGCATAACTAGCGAAATGTCACATGACCGGTACTGATCATCATTATTCGGC

GTCGGAACGGCAATGATAAAAACATCAGATGCATCTGGCGTTGTAGATACCTTCAATTTT

CCCGATGACAGTACCTCTTCATAAACCTCTTGTAATCCAGGTTCTTCAATACTAATTTGA

CCACTTTGTAACTTATCAATCGTTTGCTGATTAATATCAACACCAAGCACATCGACGCCA

TGTTTTGCAAACATAATTGATGTTGGTAAACCAATATAACCTAAGCCAACTACTGTTAAC

TTCATACTATAACCTCCAAATAAAACGATTTGTATGTTGATTTTATTTAATAGATGACTT
```

TABLE 7-continued

ATGCCTTATCTTTGGTTGTCGTTTCATCCATGATGTCCGCAATAACAAGTGACATTTTTC

CAGGAATAATTTCAAGTGCATTATTATTTTCATATAACGTATTGCTGTATATTAAATTGC

CGAATAATTTTCTAAAGACCGACAACTTATTAAAATACTTATTTAGCATTGAAGGCATGT

TGATCAATACCGTTTTACGATGTGATTGGCGACGTATTTCATACATTACTGACGATGTAT

CAAAGTAAAAACTATCTTGAGGATGGTACACACCTGTCACTTCTAATGATATTAATTGAT

CAATAAATGCTGTCAGATGTTTAATATATAATGCACTGCGCTGATTGTTAATATTGGGAA

TGATTGGCAATCGCTTTGACAATTGCATTAACCGTTGGAAATTTCCTGGGCAATGTGCAC

CATAAATCATTGGTGGTCTCACAATTGCTACTTTAAACGAATCACTAATCAATTCTTGTA

ATGCTTGTTCAGCGAACTTTTTGGAAATACCATAGTTGGTCGTAGGGTTCATTGGTGTTT

GTGTATCAACTTGATCTGATTTACCAACATGACCTTCTTTTCCATAAACTGCCATAGTAC

TCATAAAAATAAATTGTTTAACGTCTTCAGCTTTAGCCTTTTGTGCCAATTGTTTCGTCA

GCAACATATTCACTTGCATATAATCAGATAGCCTTGCTTGAGGTGAATTGTTGTGAACCA

AAGCTGCTGTATGAATTAAAACATCATAATCTTTGAACGAGGTCGACTTCCATAATTGAT

TCCTAACATTAATTTGATCTACTTGATGTCCTTGTTCAATAAGCTTATCTTTTAAAGCAT

TACCGATATATCCATGTACGCCTGTAATTAAAATATTTTTTCTCATTAGTGATGCACACC

TTCTGAAGTAACGATATTTTTAATTGTTTTATATATGATATACATATCAAGCATCATAGA

TTGATGTGTTAAGTAATAATGATCATACGCTACTTTTTGATCATCAGTGATATCATCTCT

CCCCATCACTTGAGCTAGTCCTGTCACACCTGGTCTAATCGTATGCACGTTCGCTTTTGT

ACGTTTTTCGATTAATTCGTATTGATTATAAAGCGCTGGTCTAGGACCTACAATTGACAT

TTCTCCTTTTAAAACATTCAATAATTGTGGCAATTCATCAATAGAGGTCTTACGAATGAC

CTTCCCTGTCTTTGTTATATACGATGTTGAATCCATTAAATCAGTTGCAACATTAGGTGT

GTCTATTTTCATTGATCTAAACTTATAAATATTAAACAATTCATTATTAATCGTCGGTCT

TTTTGTTTGAAAATGGCTGGTCCAGGTGATTCCATTTTTAATTAGTAATGCTGTAATTAA

CAGAATCGGACTTAAAACTACTAAACCATATATTGAACTCACTACATCGAATAATCGCTT

CATAATTATCTCCTCACTTCAACAGATTGTAATACTTCATAGTATTAATTT

LOCUS 54 (E1055)
CAGTAATTAATAAAATTTTGTCATCGAACATAATTATCTCCCTTTTTGCCATTGGCATAG

TTAATAATTTTTTCTTTACTAAAGTCATTGACGATGTCTTGAATAATCGCTTCAACTTCA

TTACATTTCATATGTTGTACTTTGCCACGATAAATTTTTTCAAATACTTGTTCAGGATGA

ACCTCATCTTTATTCATAAGCTCTTCAAACATTTTTTCGCCGGGTCTAATCCCTGTATAA

GTAATGCGTATGTCGTCTTCTTTTTTACCACTTAGCTTAATTAAATTACGTGCCAAATCT

ACAATTTTCACTGGTTCTCCCATATCTAGCACAAATACTTCGCCACCTTCTGCTAATGCC

CCTGCCTGCAAAACTAGTCTAGAAGCTTCAGGAATTGTCATAAAGTAACGTGTCATTTCA

GGATGTGTCACAGTAACTGGCCCACCTTCTTCAATTTGACTTTTGAAAAGTGGAATCACA

GATCCTCTCGATCCAAGTACATTACCAAATCTCACTGCAACAAAATTTGTTCGATGCGTT

TCATCATTTAAACTTTGAATAATCATTTCTGCAATTCGCTTTGAAGCTCCCATGACATTA

GGCGGATTAACGGCTTTATCCGTAGAAATCATAACGAATTTCTTTACCTCTGCATTTTTA

GCAGCTTCAGCAGTATTTTTCGTACCTAAAATATTATTACGTACTGCTTCTTCAGGGTTG

TCTTCCATTAACGGCACGTGCTTGTGTGCTGCTGCATGATAAACTGCGTATGGTTTATAC

GTTTCCATAATTTCAAACATACGCGCTCTATTTTGCACATCCGCTATAATAGGAACGATA

TABLE 7-continued

```
TCAACATTTTTTCCGAAGCGATTTCGCAATTCACGATTGATTAAATAAATACTGTTTTCA

CCATGGCCAAGTAGAATAATACGTTCTGGATAGAAATTACAAACTTGTCTACAAATTTCT

GATCCTATTGAACCACCTGCACCCGTAACTAAAATAGTTTTATTCGTCAATTCATTTGAT

ATCATATCCATATCTAATTCAACAGGATCTCTGCCTAGTAAATCTTCTACTTCAACTTTT

TTAAGTTGGTTCACTTCTAACTCACCAGACATGACGTCTTCTATATTTGGCATTTTCAAT

AACTCAACGCCATCCATATGGCAAATATTATTAATTTCTTTCAAACGCTCTTGACCAATA

GTTGGAATTGCAATGATGATTTTTTTAATCTTATATTTCCTCACTAGTTCTGGAATATCC

GCAATTTTACCTTGGACTTTTACACCCTCAGTAATTGTGATATTGCGTTTATGTTCGTCA

TCATCGACTGCTAATACCGGTTCAAGTTTCATTTCGTCACTTTTCAACATTTGTCTAATC

AGCATTGAACCTGCTTGACCAGCACCAACAACTAAAGTTGGCTTCTTATTAAATGACTTA

CCTCCAAGGTATTTCCGATAAATACGCCAAAATAACCTTGAGCCACCTATTAAAATCAAG

TGCATCATCCAAGTAATTAAATACAATCTAAAAAACGGTCTATTGCCTGTAACAATTGTC

ACGACCACCATCGTAATAACGATAGATGTCGTCACAGCTTTAACAATTAAAATCAATTCA

CTCACACTGGCATATTCCCACGCTCGATGAGACATATTAAAAATAAATGCTGAAATATGA

TGCGATATGAATAGTGATATAGCTGCCAATATTAATAATTTGACAGAATATGTTTTGAAA

TACGGTTCTAAAATGTAATAACTTACGAATACTGAAAATGTCACTATCAGTGAATCGATT

AATGCTAGTATTAAAAGCCGCAATTTCACAGATAAATGTGCCATAAAACCCCCTCATTGC

TGTTTATAACCCAAACCATCTTTTCTGTTTATAATCTTGTTGTGGCATTCGTTTAGGAAT

TTTTTTATCATCAACAACTAACTTCGCATTACTAATAAATCCGTTCATATCTTCATAATA

ATCACGTAATTTCTTATCATTAAATAAGTCTTTCATTAAGAACGGTCTGATTTCTGTGTT

ATGCGCATCTGAACCGATGAAATGTGTCAGATTGTTTTCAATCATTTGAATTGCTAATTT

TCTAATTTTTTTACCGGAAATACCCGCTAATGACGCCGTTGTCACTTGACTTAAAGCACC

TTTGTTAATTAAATCGTATAGTATGTCAAGGTTTTGACTTATTGCTTTATTCCGCTCTGG

ATGTGCAATAATCGGTACAAAGCCTTTACTCTGTAATTCGAAAAATAATTGATC

LOCUS 55 (E18)
ATCAAAAAGTTATGATGAACGTTTTACGCCGGATGAAGTAGTCGCATACCAACAACATCA

AGGTAATAAATTTAAAGAACATTTTGATTTGAATTGTTATCTGACACTGCTAGATGTATT

GGATAGTCACAACATTGACCGAGGTCGCACAGACGTAACGCATGTTTTTAAAAATTTAGA

AACAAAAGTGTTAACGATGGGGTTCATAGATGATTTGCTATATCCGGATGATC

LOCUS 56 (F5)
AACATACAGGTAAAGTTTTACTTGTAACTGAAGATAATTTAGAAGGTAGTATTATGTCAG

AAGTGTCAGCGATTATTGCAGAGCATTGCTTGTTCGATTTAGATGCACCAATCATGCGTT

TAGCTGCTCCAGATGTACCATCTATGCCATTTTCTCCTGTATTAGAAAATGAAATTATGA

TGAATCCAGAAAAAATCTTAAATAAAATGCGTGAATTAGCAGAATTCTAGGGAGGGAAAG

TCATGGAAATAACAATGCCTAAGTTAGGTGAGAGTGTTCATGAAGGCACCATTGAACAAT

GGTTAGTTTCTGTTGGTGATCATATTGATGAATATGAACCATTATGTGAAGTTATTACAG

ATAAAGTGACAGCTGAAGTCCCTTCCACGATATCAGGAACAATTACAGAAATTTTAGTTG

AAGCGGGGCAGACAGTAGCTATTGATACAATTATCTGTAAAATTGAAACTGCTGATGAAA

AGACAAATGAAACAACTGAAGAGATACAAGCAAAAGTGGATGAGCATACTCAGAAATCTA

CTAAAAAAGCTAGTGCAACAGTGGAACAGACATCTACTGCTAAACAAAATCAACCACGTA

ATAATGGTCGCITTTTCACCTGTTGTATTTAAACTCGCTTCAGAGCATGACATTGATTTAT
```

TABLE 7-continued

```
CACAAGTTGTAGGTAGTGGATTTGAAGGTCGTGTAACTAAGAAGGATATAATGTCAGTTA
TTGAAAATGGTGGTACCACAGCTCAATCTGACAAACAAGTTCAAACAAAATCAACATCAG
TAGATACATCAAGTAACCAATCATCTGAAGACAATAGTGAAAACAGCACAATACCAGTAA
ATGGTGTGCGTAAAGCAATTGCGCAAAATATGGTTAATAGTGTAACAGAGATTCCACATG
CATGGATGATGATTGAAGTAGATGCTACAAATCTTGTGAATACGAGAAATCATTATAAAA
ACAGCTTTAAAAATAAAGAAGGATATAATCTAACGTTCTATGCTTTCTTTGTAAAAGCTG
TAGCAGATGCTTTAAAAGCATATCCTTTATTAAATAGTAGCTGGCAAGGAAATGAAATTG
TCTTACATAAAGACATTAATATTTCAATTGCTGTTGCTGATGAAAATAAATTATACGTAC
CTGTGATTAAGCATGCAGACGAAAAGTCAATCAAAGGTATAGCTAGAGAAATTAATACTT
TAGCAACGAAAGCGCGTAATAAGCAATTGACAGCTGAAGATATGCAGGGCGGTACATTTA
CGGTAAATAATACTGGTACATTTGGTTCAGTATCATCAATGGGTATTATAAATCATCCAC
AAGCAGCGATTTTACAAGTAGAATCAATCGTTAAAAAGCCAGTAGTAATTAATGATATGA
TTGCAATTCGTAACATGGTTAATTTATGTATTTCAATTGATCATCGTATTTTAGATGGTT
TACAAACAGGTAAATTTATGAATCATATTAAACAGCGTATCGAACAGTATACTTTAGAAA
ATACAAATATATATTAGTGATAACATAGATGCATCTATCGACAACTTGTTTTATCTTGTT
CTTGTCGATGGATGTATTATTTTTTGGCACTAAAATATGTGCAATATATTCAAAAAGAT
AAAGAACAATAATCAACATGGTTGAATGCATTTTTGCAGTAAAGTCAAAATAAGACATCA
TACTTGAAACATATTAATGAAAACATGTGAACAAATTAGTTACCATGATTTTAAGCACAA
TAATGTTTGGTATATTGTTAAAATTGTGTCTAAATATAGGTGTGATTCAGATTAGTTTAT
TGAACAATATGTTATTAATTAGTAGAATGAGGATAGTTTAAATATAAAGGGATAGGTGAT
TGAACTTATGGACATGAATTTCGATTTATACATGAACGGTGTTGTAGAACAAGCAAGGAA
TGAAATTGAATCTGCGGGATATGAGCAATTAACTACTGCAGAAGATGTTGACAAAGTTCT
TAAACAAGATGGTACAACACTAGTTATGATCAATTCTGTATGTGGTTGTGCAGGTGGTAT
CGCAAGACCAGCAGCATCACATGCTTTACATTATGACGTATTACCTGATCGTCTAGTGAC
AGTATTTGCTGGACAAGATAAAGAAGCGACACAAAGAGCGCGTGAATACTTCGAAGGTTA
TGCGCCTTCAAGTCCGTCATTTGCATTAGTAAAAGATGGAAAGATTACAGAAATGATTGA
AAGACATCAAATCGAAGGTCATGATGTGATGAACGTAATTAATCAATTACAAACATTATT
CAATAAATATTGTGAAGAAAGATAAGAGGCGCTAACCCATGTTAAAGTTAAATCCTTACA
AGATTGGATTTAGAACAATAAAAACAGCAGTGGGTATGACTTTAGGTGTAATTATTAGTA
AGCTGTTAGGTTTAGATAATTATGCTTCAAGCGCCATATTAGTCGTATTATGTATTAAAC
ATACAAAAGTACATTCGCTACAAGCGATTATTTCAAGATTAGTATCATGTTTTTTAGTAT
TGTTTTTAGGTTCAGCAATXTITAGTTTATTAGGTCAGAGTCCAATTGTACTCGGTATTA
TCGTATTGTTATTTATACCATIAACTGTCGTATTAAAAGTACAAGAAGGTGTCATTACGA
GTTGCGTTATATTACTTCATGTTTTTAATGCAAAATCAATTGATGCACATTTAATTGTTA
ATGAAACATTATTACTGTTAATTGGACTAAGCATTGCATTTACAATGAATTTAATGATGC
CAAGTTTAGACAAACAACTAGACGAATACAAATGTAAAATTGAGCAACAAATTGCTGATA
TTTTTAGTAAATATAGTTATATTTGTGAAAAATATGAAGATACCATTGCGATTGAATTTG
AAGTGTTACTTTTAAATATTAAAAAGGCGAAGTCTATCGCGTTCCGAGATGTTAAAAATC
ATTTTGTTAGAAACGAAAATTCATACTATCATTATTTTGATATGCGAGAAGAGCAAGTGG
AATTGTTAATGAGAATGAAACCGCTCATCGAAAGTATCTGTCATAAAGATCC
```

TABLE 7-continued

```
LOCUS 57 (F3)
GATCTTCGCGTCTTAATGGATGCCATATACGAACTGAATGACCACCAAGATTTGCGTGAG
ATTACTAAAGATTCGAAAATGCAAAAACTCGCATTAGCAGGATTCCTTAAAAAGATAAAA
GGTACGTACATTGAGTCATTATTAAAAGAACACAAATTGTTATAACGAAAACCATTAATA
GATTTTTATTTGGTGATTTCAAATCATGAGACTGGGACAGAAATGATGTTTTCATAAAAA
TTATTTCGTTGTTCCACTCTCATGATTTTTTGATGAAACATAATTACATGATTGATTGC
ATCATTTTGTTAAACAAGTGATTGCAAACCTGCCATTTCACACTGAAAATTTACATAATA
AGTGACGATATTTTACAAGTCATATACAAATAACATATATTGTTAAATAATTTTACCTAA
TCTTAACATTAAATTTACAATTATAAGCGATAATCTAAATATAAAGCTTATTTGAGGTGA
AATAATGGAAATGTCGGTTACAGAAGTCATTTTCTCCTTTTTAGGTGGTTTAGGTATTTT
CCTTTACGGCTTAAAAAATCATGGGAGACGGCTTCAAGCATCAGCAGGAGACAGGCTACG
AGATATTTTAAACAAATTTACATCAAATCCAGTATTAGGTGTTATTGCAGGTATCGTTGT
AACTATTTTAATACAAAGTAGTTCAGGTACGACAGTTATCACAATCGGACTGGTAACAGC
TGGATTTATGACATTGAAACAAGCCATTGGAGTGATAATGGGTGCTAATATCGGAACAAC
GGTAACTGCATTTATTATCGGTATAGATTTAGGCGAATATGCAATGCCAATTTTAGCATT
AGGTGCATTCTTAATCTTTTTCTTTAAACGCTCTAAAATCAATAACATTGGCCGCATACT
ATTCGGTTTCGGTTCACTATTCTTCGGTCTAGAATTTATGGGTGATGCCGTTAAACCTTT
AGCATCATTAGATGGATTTAAGCAATTAATGCTTGATATGTCTACAAATCCAATACTCGC
TGTCATTGTCGGCGCAGGGTTAACAGCACTAGTTCAAAGTTCAAGTGCGACGATTGGTAT
TTTACAAGAATTTTATCAACAAGATTTAATTAGCTTAAACGCAGCAATCCCTGTGTTACT
AGGCGATAACATTGGTACCACGATTACAGCTATCTTAGCTAGTTTAGCCGGCTCAATCGC
TGCAAAACGTGCGGCGCTTGTACACGTCATCTTTAACTTAATCGGGGTAATTATCTTCAC
AATTTTCTTGCCAGTTGTGATTCATTTGATTAGTTTGTTACAAGATTTATGGCACTTAAA
ACCAGCGATGACGATTGCAGTATCACATGGTATCTTCAACATAACAAATACTTTGATTCA
ATTACCATTTGTAGCAGGTTTAGCATGGATTGTTACAAAGCTTGTCCCAGGTAAAGATAT
TGCTGATGACTATAAACCTCAGCACTTA
LOCUS 58 (G8)
GATCCAAAATCACTTGTTTGATTGGTTTATTCTTATTAGACTGTTGATGAATTCGATTTA
AATAATACGTCAATGCTTCATTTGAAAAAGGTTCAGGCGCTATTTCTAAAAATGAAGGAT
AAGATGCTACAGACGCAACATTTCTAATTTCTCCAAAACGACGTATATCTGAATAAATTA
ACTTTTTGTCATTTGACAACTCAAAAATAACATGCCAATGCTTACGATAATTAGGTATCA
TAATATCTTCAAGTTCATCTACAATGAAAAAACCGCCCGCCATACCTAAATGACTAATTA
ATGTACTGGTGGCTCGTTTATTATCTAGCTGAAAAACGATATATTTACTTCTTCGTTCTA
CATTTGTAATGGTATAGCCTTCCGATAAAGTTTTAAAAGTATCTAATTCAATTCCTTTTA
TAATTGTTTCCTTGCCTTGAGCTTTACCTTCGATTACTTTATCCGAAAATATAACGTGTT
CAATTTTTTGATTTATAACGTAGGGTTCAATTCCTCTTTTTACATGTTCTACTTCTGGTA
ATTCGGGCATACCATTAACCTCACTTTATTTTGCATCATACCAGGTTGCACCATAACTTG
AGTCTACTTTTAATGGAACATCTAATTGCAATGCATTTTCCATTATCTCTTCTACAAATT
CACTAAATGAATCTACTTCTGACTTAGGTACTTCAAAAATTAATTCATCGT
LOCUS 59 (G23)
CTTGTAATTCTTGTTGGTTAAAATATGGATGTACCTCAATTTGATTCACCATTGGTTTGA
```

TABLE 7-continued

```
TACTTGATTGAGCCATTAATTTTTCTAGATGATGAACATTAAAATTACATACACCTATTG
CTTTTACCTTACCTTGCTCGTAAAGTTCTTCCATAGCTTTATATGTTTCTAAAAATAGAC
CATCTGCTTCACAAGGCCAATGTATTAGAAATAAATCAAGATAATCAGTTTGTAAATTTT
CAATCGATTTGTTGAAATATTCGAATGTTTTCTCATAACCTTGATAGTCATTCCATAACT
TCGTTGTTATAAACAAATCTTCTCTATCGACGCCATTATCCTTTAATGCTCGTCCTAGTG
AAGCCTCATTATCATAAAAGTATGCTGTATCAAACGCTCTATAGCCTGCGTCAATTGCAG
CATTTACAACTTTAGTCATATCTTCGTCAGAGATTTTATAAACACCTAACCCAACTGAAG
GCATCGGGTATCCATTATTTAATATTTGTATCTCATTCAACATCTTTATATCTCTCCAAT
CTATGTATCTTTTATATCTTTACATTACCCTAAATTTTTCAACAAACTCAATTAATACGA
ATTATCGCTTTCAATAAAAATTATTCATTAAATCATTAAAGATATTGAGTTCCAATACTA
TTTTCACTTTTCATTAATTTTAGTCAAAAAAATAACCAACCAAAAATGAATTAAATCATT
CTTAGTTGGTTTATATATTAATATCTATTCTGATTTTTCATCTTCATCAGACTGTCCGAT
AGTAGGTCTCGCTTCATTAAATTCATAGTTTAATATCACCCAATAATTTGGTGGTTATC
GATTTCTGAAACAACCCAGCGATCATAAGTTGTATCCACGTAATCATCTTTTTGTAAATT
GGTATTACGAGATTGTAACCATCCACCTATCGTATCAATATCCTCAGAGTCATCAAATTC
TATACCGAACTCTTCAGTTAAATCATCCAATAGTACTCTGCCATTTACTTGGAATGTCTT
ATTATCAATTTTAACGATATCATTCACTTCATCATCATCAAATTCATCACGAATTTCTCC
AACGATTTCTTCTAAAATATCTTCCATCGTTAAAATACCTGCCGTTCCACCATATTCATC
TATAATAAGACTCATATGTACATGTTCACGTTGCATTCTAATTAATGCATCACTGATACG
TGTTGTCTCTGAAATCATTGGCAACTCATGTATATAGTTTGCTATTTTAATCGTTTTTCC
AGAAGCGTATTCAGTTAAAAATTCTTTGACGTTAATAAATCCTTTAATGTGGTCTTTATC
ACCATCATCAGTAATTGGATAACGCGTAAATTGATGTTCTTTTATTGTTTCTAGTAATTC
GTCTACATTAAAAGGTTCATTTAGTGTAATCATTTGAGTTCTAGGTACCATTATATCTTT
TGCATGTCTTTCATCGAATGAAAAGATATTTTGCATATATGCCAATTCAGTTTGGTTGAT
TTCTCCACCATTATAACTATTGTTAATAATAATTTTGATTTCTTCTTCTGACATTGCATC
AGTTTGGGCATCAGGATTTACACCAAACATTCTAATAATAACACGTGCAGAACCATTCAT
CAGCCAAATCAATGGTTTCATAATGTTACCGAAATAGAACAATGGTCTTGCATATACTAA
AGCAAGCTTTTCAGTATGTTGAATAGCTATAGATTTAGGCGCTAATTCACCAAGTACTAC
ATGCAAATACGTAACGATTATAAATGACACTGCAAACGAAATCGTCGTCGTTAATGCAGT
TGGTAAATTGATTGCTTCAAATATTGGGTGTAATAGCTTTTCAAACGTTGGTTCACCAAG
CCAACCTAACCCTAAAGATGTTACTGTTATACCTAACTGACAAGCAGAAAGATAATAATC
TAGATTAGCAATCATCTTTTTTACTATTTTAGCAGGTTTATTTCCTTCATCTGCTAGCTG
TTCAATTCTTGTTGCTCTAATTTTTACTAATGCAAATTCTGAACCAACAAATACAGTGGT
TAATGCAATTAATAGAATAAATATAATCAAACTAATTATGGTCGAAGTTTCCAATTAATT
CCCTATTTCTAGGGATTCACCTCCATGTTATATGTGTCACTCATGGGTAACACGCATTCA
AATTTATCACTATGACTTAAATTACAACTACATGTTATCGCCTTCCCATTTAGACACCCC
CAGAAAAAAATGTTATTGCTTCTATTTTATCATAATATAAAGTGCTTATGTTAACAGATT
AAATCTATTGCATACATTTAATTATGATTAT
LOCUS 60 (G29)
TCTTCTGAGAAGGTTTTTGACCCATTTGCATCATCATCATACGAAGCATTTCTTCGTTGA
```

TABLE 7-continued

```
TTGGTGGGTTTTCTTCAAGTAGTCCATCATATATTTTCTAGCTAAAAGGAAACCTCCAA
TTAAACCTAAAATTAATGCAGCTACTATAAAAATAATTGCTACCCAAGTTGCCATTGTTT
CACCCGCTTTCTTTATCCTACTGAATTTTGCTAAATTCATCACATTATTTCAAGAACTAG
TTTATTCAAGTATTTTAATATCGATACTAAAAATAATATCAAAAATCATGCTGTTATAAC
AGAGCTTTTAAAGATTAATCTGAAATAGTATACTTTCATAACTTATCACTTATGATGTAG
TTTAAGTGCTATACTCTAAATTTCAACACTTTAAAAAAAGCCTAAGATTATGCATCCTAG
ACTTCTAAACATACTCGCTTTATAAATTATTCTTATAAGCTCATAACTTGGTTTAAGATA
TTTTCTTTTGTAAATCCATATTTTTCAACTACTAAATCGCCAGGTGCACTTGCGCCAAAG
CCGTCAATAGCAATAACTTTACCTGCAGTACCTACATATTTATGCCATCCAAGCGGTGAA
GCCATTTCAATCGCAACACGTTTTGTTACGCTTGATGGAATAACTGATTCTTTATATTCT
TCAGATTGTTGTTCAAATGCATTCCAGTTAGGCATTGAAACAACACGTACTGATTTACCT
TGTTTTTCAAGATCTTTAGCAGCTTCAACTGCAAGACTAACTTCTGAACCTGAAGCThAT
AATAGGAATTCTGGTGTCTCTTCAGAGCCATAAACTGTATAGGCACCTTTTCGAACGCCT
TCTTCAACTACATCTTCTGGTACATCTAATACCGGTAAGTTTTGACGTGTCAATACTAAT
GAAGTAGGTGTAGATTCAGATTCTAAGGCAACTTCCCATGCTACTCTTGTTTCATTACCA
TCAGCAGGACGGATAACATTCATATTTGGAATGGCTCTTAATCCAGCTAATTGCTCAATT
GGTTCATGAGTAGGACCATCTTCACCTACTGCAATTGAATCATGTGTGAAGATGAACGTT
CGATTTAATCCCATAATTGATGATAAACGTAACGCTGGTTTTAAATAATCACTAAATACG
AAGAATGTTGCACCATATGGATGTAAACCTCCATGTGCAGCCATACCATTTACAGCAGCA
CCCATAGCAAATTCACGTACACCAAACCACACATTTTTACCTTCAGGTGTTTCAGAACTA
TAATCAGTTGCATCATTTACATTGGATTTGTTTGAACCAGCAAGGTCTGCTGATCCACCA
AAGAATGAAGGGACAGTTTTACTGATTGCTTGAATAACAGTACCAGAATCAGCACGAGAT
GCACCATTATGACCCAGTTCAAAACGTGGTAATTCATCCTTATAATTTTAGGCAATTTA
CCACTAATCGCTAATTTAAATTCTTCTGCTAATTCAGGATATGTTTCTGCATATTTTCT
AATAATGAATTCCATTGAGATTCATCTTCATTAGCACGTTTTAACATAGTATTTTGGAAA
ATTTCGTATACCTCTTCTGAAACATTAAAACGTTTTTCAGGATCTAAACCGTAATTTTCG
AATGTTAATTTTCTTTCAACTTCACCTAAAGGTGCCCCATGAACACCATTAGTTCCTGCT
TTATTCGGTGAACCAAATCCGATTGTTGITTTAACTTCAATAATCGTTGGTCCTTCTTGA
GATTTAGCTGTAGTAATCGCTTTATCAATTTCTTCTAAATCATTACCATCTTTAACTAGT
AAGTAATTCCAACCATATGCTTCAAAACGAGCTTTTGTGTTTTCAGAAAAAGCTTTGTTT
AATTCGCCATCTAATGAAATATCATTTGAATCGTATAAAACAACTAATTTACTTAATTTA
TTATGTCCAGCAAATGAAGCTGCTTCATGCGATATACCTTCCATTAAATCACCGTCAGAA
GCTAATACATATGTGTAATGATCTACAACATTATATCCTTCTTTATTAAATTTCCCTGCT
AGGTGATCTTCTGCTAAAGCTAATCCTACTGACATAGCAAAACCTTGTCCAAGTGGTCCG
GTAGTAACTTCTACACCATCTGTATGTCTGTATTCAGGATGACCTGGTGTTTTAGAACCC
CATTGTCTAAATTGCTTTAATTCTTCTAATTCTAAACTACCAGAAACATGTAACAAGCTA
TACAATAATGCTGAACCATGCCCTGCAGATAATACGAAACGGTCTCTATTGAAGTAATCT
TTAGATTGTGGATTAAAATTCAGATGACGTGTCCACAAAGTGTAAGCCATTGGGCAGCT
CCCATAGGTAATCCTGGATGACCAGAATTCGCTTTTTCGATTGTGTCGATACTTAGTGCA
CGTAGCGTATCAACAGCTAATTGATC
```

TABLE 7-continued

```
LOCUS 61A (HA7)
GATCTAGGTATGGATAAAGACGAAGCCAAAAAGTTATTCGCCAAATCTGAAAGTATTTTC

AAAGACCTTAAAGGCGTAAAATACAAAGTAGACTATAAAGATAAAAAAGCAATIGAACAC

TTAGACATAGATTACACAGAAGTTGACATGAAAAAATTAAATAAACGTCTTGGTGTTTCG

ACTAAAGAAAATAAAGATATTAGTTTTGAAAAACTTGAAAAGCAATTAAAGCACAGAGCT

TTAAAAGAAAAAGATAAAATGGACGACAAATAGTTTATAACTTAAAAATGCCCTCAGATA

AGACTAAGGTTACAAACCTTAATTCATATTCTGAGGGCTTTAATATTTGAAGTTCTTGTG

TGACCAGCATCCACTACTAATATAAAATTATTTGCAGTAACGCTAAAATCCGCTGCTTTC

AATTTCCCGAAATAATTAAGTTAACTAATGAGTTTTAATTTATAATCATGTATCGTTTGT

AACTCACCATCGACTTTTCGATATACAATATGATCAGCAGTAATTTCTGTAGGACTGGAT

ACGCCAACAGCTGCTGCAATATTGAATAAGCCTTCATGCAAACTTGTTACATAGTTTGTG

ACACGATATTGCTTTTCTCCAACAATCAATGCTTTTCTTTCTTCGCATCTGTCGTTGCA

ACACCTACAGGACACGTATTCATGTGACATTGTTGACTCATTATACAACCGACACTAATC

ATCATCCCACGTGCGATATTTACAAAATCTGCACCTAAACCTAGTGCAATCGCAATTTTA

TCTGGTGTCACTAACTTACCAGATGCCGCCAATTTCACTTTATCTCGAATACCATATTTT

TCTAACATGCCAGACACAATAGGTAGAGCTGTAAATAGCGGTAAGCCAACACCATCTTGT

AATTCTTGGAATGTTGCACCAGTACCACCTTCACCACCATCAATCGTAATAAAGCTTGGA

TACTTATCTAGTTCCACCATCGTACGTACAAGTGTTTCAATTTCTGAAACTTTGCTTACT

ACAATTTTGAATCCTACTGGTTTTTGACCTAATTGCTGCAACTGATC

LOCUS 61B (G28)
AGGTATGGATAAAGACGAAGCCAAAAAGTTATTCGCCAAATCTGAAAGTATTTTCAAAGA

CCTTAAAGGCGTAAAATACAAAGTAGACTATAAAGATAAAAAAGCAATTGAACACTTAGA

CATAGATTACACAGAAGTTGACATGAAAAAATTAAATAAACGTCTTGGTGTTTCGACTAA

AGAAAATAAAGATATTAGTTTTGAAAAACTTGAAAAGCAATTAAAGCACAGAGGTTTAAA

AGAAAAAGATAAAATGGACGACAAATAGTTTATAACTTAAAAATGCCCTCAGATAAGACT

AAGGTTACAAACCTTAATTCATATTCTGAGGGCTTTAATATTTGAAGTTCTTGTGTGACC

AGCATCCACTACTAATATAAAATTATTTGCAGTAACGCTAAAATCCGCTGCTTTCAATTT

CCCGAAATAATTAAGTTAACTAATGAGTTTTAATTTATAATCATGTATCGTTTGTAACTC

ACCATCGACTTTTCGATATACAATATGATCAGCAGTAATTTCTGTAGGACTGGATACGCC

AACAGCTGCTGCAATATTGAATAAGCCTTCATGCAAACTTGTTACATAGTTTGTGACACG

ATATTGCTTTTCTCCAACAATCAATGCTTTTCTTTCTTCGCATCTGTCGTTGCAACACC

TACAGGACACGTATTCATGTGACATTGTTGACTCATTATACAACCGACACTAATCATCAT

CCCACGTGCGATATTTACAAAATCTGCACCTAAACCTAGTGCAATCGCAATTTTATCTGG

TGTCACTAACTTACCAGATGCCGCCAATTTCACTTTATCTCGAATACCATATTTTTCTAA

CATGCCAGACACAATAGGTAGAGCTGTAAATAGCGGTAAGCCAACACCATCTTGTAATTC

TTGGAATGTTGCACCAGTACCACCTTCACCACCATCAATCGTAATAAAGCTTGGATACTT

ATCTAGTTCCACCATCGTACGTACAAGTGTTTCAATTTCTGAAACTTTGCTTACTACAAT

TTTGAATCCTACTGGTTTTTGACCTAATTGCTGCAACTGATCGACGAAACGAATCAAATC

TTCAGCATTATGAATAAATTCGTAACGGTTAGGTGAATTGATTGTTTTATAAGGTTCAAC

ATTTCGGATTTTAGCAATTTCTTCGTTTACCTTTTCAGCTTCCATATGACCACCACGAGT

CTTAGCACCTTGTGCCAACTTCAGCTCAAATGCGCGTACGTTAGATAACTGTGCAACCTC
```

TABLE 7-continued

```
TTTAAATAAACCTTCACTAAAATTACCTTCTTTATCACGAACACCAAATAAACCGGGACC
AATTTGGAAAATGATATCCCCATTACCTTTTAAATGATATTCTGATAAGCCACCTTCACC
TGTATTCATCCAAGTGCCCGCITTAGCTAGACCTTTAGATAAAGCTGTAATGGCATTTTT
TCCTAAAGCGCCATAACTCATACCAGATTGTCCTACGATACGTTTTAAAATAAATGGATG
TTTTAAATGTTCACCTAATTTTATTGCATGGTCATCACTTAAGTAATACGGATCAATCTT
TGTCGGCACACGATATTCTTCACGACTAAATAAACGCTCATTCGCGATTTTATAAATGAA
TGTTGATAACAATGTTGTATTATCTACTGAAATCTCATTACGTTGCATCGGAAACATTGT
GTTCTGTATGTAAAAGCCGTCTTGATAATCTTTAGTAGTACCGAAGCTGGTCATACGAGA
GTTATATTTTCCAGCCAAAACGATATTTTTATAATCATTACGTGAAAAAGGTTTCCCTTC
ATTATCCCCAGAAAATAAATACTGACGTAATTCCGGTCCCATTTTTCTGAAATATATCT
AATACGTGCTAGTAAAGGATAATTCCTTAATACACTATGTTGTGATTGTCTTTTATCTTT
AATTAACCAAATAAGCCCGATAACAATAACCGTAAGCATGAATCCTACAACGATAATGTT
AACTATAAATTGCATGACTGTAAGAAACGTCATTACAATACCTCCCCCCAAAATTTCAAT
TCAATATTTATGATACACCTTACAAAACAAAACACAATGGAAGCGCTTCATTTTATAAAA
CAATTTTATGATATGTTTTTCATTTTAAATTTTAATGTATAAAACATACAATACAAAGTA
ATATGTGCTAAAGTATCTATATAATACAACTATTTAAGAGGTATACTATGTCAAATACAA
ATAAACATTACATAGAAGAAGAATACGCTACCGAACAATCGCGTTTTTTCAAACGTGATA
TTGGATTTATTTTCCTTTACATATTTTTGCTTAACATCTTGCCGATC

LOCUS 62 (H3)
GATCCTTTTGTTGTAGACGTAATACGTTCTTGTAATTGTCCCATTTCAGTAGCAAGTGTT
GGTTGGTAACCTACTGCAGAAGGCATACGACCTAATAATGCAGATACCTCAGAACCAGCT
TGTGTAAATCTGAAAATGTTATCGATGAATAATAATACGTCTTGACCTTGTTCGTCACGG
AAATATTCAGCCATTGTTAAACCAGATAATGCAACACGCATACGTGCACCAGGTGGCTCA
TTCATTTGCCCGAATACCATGGCTGTTTTCTTAATTACACCACTGTCACTCATTTCGAAG
TATAAATCGTTACCTTCACGAGTACGTTCACCTACACCGGCGAATACAGAAATACCACCG
TGCTCTTGAGCGATGTTGTTAATTAATTCTTGGATTAATACTGTTTTACCTACACCGGCA
CCACCGAACAATCCGATTTTACCACCTTTAATATAAGGTGCTAGTAAATCTACTACTTTA
ATACCTGTTTCTAAAATTTGAACTTCTGTTGAAAGTTCATCGAATGCTGGTGCTTGACGA
TGGATAGGATCGCGGCGAACAGAATCACTAATTTCTTCTTTAAGGTCAATTGTTTCACCT
AGTACATTAAATACACGACCTAATGTTTCGTCACCAACAGGTACACTAATTTCTTTGCCT
GTATCTTTTACATCCATGCCTCTTTGGACACCATCAGTTGAATCCATCGCAATTGTACGA
ACAACGTCGTCACCTAATTGCAGCGCAACTTCTAATGTTAGTTGTATTGTACCTTCTTCT
TTAGGCACATCAATAACCAAGGCGTTATTAATTTTAGGAACTTCGTTATGTTCAAATCGA
ACATCAATTACAGGACCCATAACTTGAGTTACACGGCCAATTCCCATGCTATTTTCCTCC
TTTAAATATTATTCAAGCGCTGCCGAACCACCAACAATTTCAGTAATTTGTTGCGTAATT
TCTGCTTGTCTCGCTCTGTTATATTCTAATGATAAGTCATCAATAAGTTCAGTTGCATTA
TCAGTGGCATTTTTCATCGCAGTCATACGTGTTGCATGCTCACTTGCTTTTGCGTCTAAT
ATTGTTCCGTAAATCAAACTCTCAACATATTGAGGCAAGATTACACTTAAGATAGATTCT
TTATCTGGCTCAAATTCATAAGAAGACAAATGACCATGCCCCTTACTAGAATCCTCTTGA
GATAATGGTAATACTTGTCTAGATGTAGGCTTGTTTTCAAGAACGCTGACATAATGACTA
```

TABLE 7-continued

```
TAGTATATATTTAATTCATCAATTTCTTCTTCACTGTATAAGTCTATAGCATGGTTAGCT

AGTGCTTGAACAGATTTGAAAGAAGGTTGATC

LOCUS 63 (GD10)
GATCCTATTTTTAAACAAGAAGTAGAGAATCTTGAAAAAGAAATAAGAAATGTATAAGTA

GGAAACTTTGGGAAATGTAATCTGTTATATAACAGCACTAATGATAACAATCATTTTTA

CATTTCTATATGCTAATGTGGCAAGATGAGCAAAACTCATTTTGTGGATAATGTTTAAAA

GTCATACACACCATACACAAGTTATCAACATGTGTATAACTTCGCCAAATCTATGTTTTT

AAGACTTATCCACCAATCCACAGCACCTACTACTATTACTAAGAACTTAAAACCTATATA

ATTATATATAAACGACTGGAAGGAGTTTTAATTAATGATGGAATTCACTATTAAAAGAGA

TTATTTTATTACACAATTAAATGACACATTAAAAGCTATTTCACCAAGAACAACATTACC

TATATTAACTGGTATCAAAATCGATGCGAAAGAACATGAAGTTATATTAACTGGTTCAGA

CTCTGAAATTTCAATAGAAATCACTATTCCTAAAACTGTAGATGGCGAAGATATTGTCAA

TATTTCAGAAACAGGCTCAGTAGTACTTCCTGGACGATTCTTTGTTGATATTATAAAAAA

ATTACCTGGTAAAGATGTTAAATTATCTACAAATGAACAATTCCAGACATTAATTACATC

AGGTCATTCTGAATTTAATTTAAGTGGCTTAGATCCAGATCAATATCCTTTATTACCTCA

AGTTTCTAGAGATGACGCAATTCAATTGTCGGTAAAAGTGCTTAAAAACGTGATTGCACA

AACAAATTTTGCAGTGTCCACCTCAGAAACACGCCCAGTACTAACTGGTGTGAACTGGCT

TATACAAGAAAATGAATTAATATGCACAGCGACTGACTCACACCGCTTGGCTGTAAGAAA

GTTGCAGTTAGAAGATGTTTCTGAAAACAAAAATGTCATCATTCCAGGTAAGGCTTTAGC

TGAATTAAATAAAATTATGTCTGACAATGAAGAAGACATTGATATCTTCTTTGCTTCAAA

CCAAGTTTTATTTAAAGTTGGAAATGTGAACTTTATTTCTCGATTATTAGAAGGACATTA

TCCTGATACAACACGTTTATTCCCTGAAAACTATGAAATTAAATTAAGTATAGACAATGG

GGAGTTTTATCA

LOCUS 64 (F5)
AACATACAGGTAAAGTTTTACTTGTAACTGAAGATAATTTAGAAGGTAGTATTATGTCAG

AAGTGTCAGCGATTATTGCAGAGCATTGCTTGTTCGATTTAGATGCACCAATCATGCGTT

TAGCTGCTCCAGATGTACCATCTATGCCATTTTCTCCTGTATTAGAAAATGAAATTATGA

TGAATCCAGAAAAAATCTTAAATAAAATGCGTGAATTAGCAGAATTCTAGGGAGGGAAAG

TCATGGAAATAACAATGCCTAAGTTAGGTGAGAGTGTTCATGAAGGCACCATTGAACAAT

GGTTAGTTTCTGTTGGTGATCATATTGATGAATATGAACCATTATGTGAAGTTATTACAG

ATAAAGTGACAGCTGAAGTCCCTTCCACGATATCAGGAACAATTACAGAAATTTTAGTTG

AAGCGGGGCAGACAGTAGCTATTGATACAATTATCTGTAAAATTGAAACTGCTGATGAAA

AGACAAATGAAACAACTGAAGAGATACAAGCAAAAGTGGATGAGCATACTCAGAAATCTA

CTAAAAAAGCTAGTGCAACAGTGGAACAGACATCTACTGCTAAACAAAATCAACCACGTA

ATAATGGTCGCTTTTCACCTGTTGTATTTAAACTCGCTTCAGAGCATGACATTGATTTAT

CACAAGTTGTAGGTAGTGGATTTGAAGGTCGTGTAACTAAGAAGGATATAATGTCAGTTA

TTGAAAATGGTGGTACCACAGCTCAATCTGACAAACAAGTTCAAACAAAATCAACATCAG

TAGATACATCAAGTAACCAATCATCTGAAGACAATAGTGAAAACAGCACAATACCAGTAA

ATGGTGTGCGTAAAGCAATTGCGCAAAATATGGTTAATAGTGTAACAGAGATTCCACATG

CATGGATGATGATTGAAGTAGATGCTACAAATCTTGTGAATACGAGAAATCATTATAAAA

ACAGCTTTAAAAATAAAGAAGGATATAATCTAACGTTCTTTGCTTTCTTTGTAAAAGCTG
```

TABLE 7-continued

```
TAGCAGATGCTTTAAAAGCATATCCTTTATTAAATAGTAGCTGGCAAGGAAATGAAATTG
TCTTACATAAAGACATTAATATTTCAATTGCTGTTGCTGATGAAAATAAATTATACGTAC
CTGTGATTAAGCATGCAGACGAAAAGTCAATCAAAGGTATAGCTAGAGAAATTAATACTT
TAGCAACGAAAGCGCGTAATAAGCAATTGACAGCTGAAGATATGCAGGGCGGTACATTTA
CGGTAAATAATACTGGTACATTTGGTTCAGTATCATCAATGGGTATTATAAATCATCCAC
AAGCAGCGATTTTACAAGTAGAATCAATCGTTAAAAAGCCAGTAGTAATTAATGATATGA
TTGCAATTCGTAACATGGTTAATTTATGTATTTCAATTGATCATCGTATTTTAGATGGTT
TACAAACAGGTAAATTTATGAATCATATTAAACAGCGTATCGAACAGTATACTTTAGAAA
ATACAAATATATATTAGTGATAACATAGATGCATCTATCGACAACTTGTTTTATCTTGTT
CTTGTCGATGGATGTATTATTTTTTGGCACTAAAATATGTGCAATATATTCAAAAAGAT
AAAGAACAATAATCAACATGGTTGAATGCATTTTTGCAGTAAAGTCAAAATAAGACATCA
TACTTGAAACATATTAATGAAAACATGTGAACAAATTAGTTACCATGATTTTAAGCACAA
TAATGTTTGGTATATTGTTAAAATTGTGTCTAAATATAGGTGTGATTCAGATTAGTTTAT
TGAACAATATGTTATTAATTAGTAGAATGAGGATAGTTTAAATATAAAGGGATAGGTGAT
TGAACTTATGGACATGAATTTCGATTTATACATGAACGGTGTTGTAGAACAAGCAAGGAA
TGAAATTGAATCTGCGGGATATGAGCAATIAACTACTGCAGAAGATGTTGACAAAGTTCT
TAAACAAGATGGTACAACACTAGTTATGATCAATTCTGTATGTGGTTGTGCAGGTGGTAT
CGCAAGACCAGCAGCATCACATGCTTTACATTATGACGTATTACCTGATCGTCTAGTGAC
AGTATTTGCTGGACAAGATAAAGAAGCGACACAAAGAGCGCGTGAATACTTCGAAGGTTA
TGCGCCTTCAAGTCCGTCATTTGCATTAGTAAAAGATGGAAAGATTACAGAAATGATTGA
AAGACATCAAATCGAAGGTCATGATGTGATGAACGTAATTAATCAATTACAAACATTATT
CAATAAATATTGTGAAGAAAGATAAGAGGCGCTAACCCATGTTAAAGTTAAATCCTTACA
AGATTGGATTTAGAACAATAAAAACAGCAGTGGGTATGACTTTAGGTGTAATTATTAGTA
AGCTGTTAGGTTTAGATAATTATGCTTCAAGCGCCATATTAGTCGTATTATGTATTAAAC
ATACAAAAGTACATTCGCTACAAGCGATTATTTCAAGATTAGTATCATGTTTTTTAGTAT
TGTTTTTAGGTTCAGCAATATTTAGTTTATTAGGTCAGAGTCCAATTGTACTCGGTATTA
TCGTATTGTTATTTATACCATTAACTGTCGTATTAAAAGTACAAGAAGGTGTCATTACGA
GTTGCGTTATATTACTTCATGTTTTTAATGCAAAATCAATTGATGCACATTTAATTGTTA
ATGAAACATTATTACTGTTAATTGGACTAAGCATTGCATTTACAATGAATTTAATGATGC
CAAGTTTAGACAAACAACTAGACGAATACAAATGTAAAATTGAGCAACAAATTGCTGATA
TTTTTAGTAAATATAGTTATATTTGTGAAAAATATGAAGATACCATTGCGATTGAATTTG
AAGTGTTACTTTTAAATATTAAAAAGGCGAAGTCTATCGCGTTCCGAGATGTTAAAAATC
ATTTTGTTAGAAACGAAAATTCATACTATCATTATTTTGATATGCGAGAAGAGCAAGTGG
AATTGTTAATGAGAATGAAACCGCTCATCGAAAGTATCTGTCATAAAGATCC
```

LOCUS 65 (F110)
```
AACGACCACAAAACATACACAACTACATTTTCTCTAATTATTTATATAAATATTTTATCG
TTAAAATTATATCATGATTCTCTACCATTATGTATAACTTATTTATATTTTGCACAAG
ATATAATATTGTCCAACTTTAAATATCCAAACCTATTAATAATAAAACTAGATACCATCG
TACTCTATCATGGCTTTCTTATAATCGAGTAGAAGCATCATCATTACTTGATTATTTGCT
CTTTACAACACCGAGCGTGCCCGTACTCGGTAATTCAATACCTTGCGTAACCCGTCACTG
```

TABLE 7-continued

```
TGAGTTGGGTTAATGATAATAAAGCCCACACCTTTTAAAAAGATGTGGGTAATTTATATA
ATTTTTATTTACATTTTTAACTTATAAAAAAAAGCGCCTATGTCATGATTTACCATCACA
TAGGCGCTTATCAATAAATTATTACTTATTACTTTCCATTTCATCTAATTTATGCGGATT
TCCTGTAATTAGATGACAACTTATTCTTTTCAGGGGAACATTACACTTTTATAATATGTT
CAAAGACAAACTTAACCATTCACAAATATAAAGAATAATATTATCAAATCATTGAACAAA
TCGTATTTTGCAACAATTGATATTTATATTAATGTATTGCATTTAATTTATAAAATTCAT
ATACATCTTAATATTCTCAATATCGATTTGTATTGTCAACTTTATATAGATTTAAAAAAA
TAATCTCATGTCTTTTTTTACAAAAGTAAGTTAATTATTACAAACTAGTAACAAAAATTA
TTTCTTCAAAAATATATTTAGTAGCGAATACACTTCATCTTTGAATTGACTTTTACTTTC
TTCCACTGCTCCAAATTTTTGCGAAAAGGATGCTTTCAAATACCAACTTTCAAGAAACAG
CAATATTAAATTCTGAAAGTCTTCTTTTGTCATCTTTATCTTTGATTCATCATAGAATTT
TGCTATCTCTTTACTTAATGATTGATTTAAATCTTGTATTTGTCCGTAAATATTTCCAGA
AAATTCCTCAGGCGTATTAGATAATTGAACGTACATTCTAATATACCTTTCTTCCATGTC
GAAAATAAACTCAAATAAGAATTGATATAAAGCATCAATTGAATAGTTCGATTTATTTTG
ATTCATCATAATAATATTATTAAGGTAATCAAAACAACATTTAACACTTTGTTCGTAAAT
ACTTTTTTTCGAGTCAAAATGGTAATATAAACTCGCTTTCTTTATATTTACACTTTTAGC
TATATCATCAAGTGTTGTACCGTCATACCCCTTCTCTGAAAATAAGGTTATTGCGTTATC
AATAATCTTATCCTTCAATTTTTATAACCCCCTACTGAAAATTAATCACACTATGTTACA
GGAAAATTAAGTTGCAATTACAAATATTTCCGTTTAATTATAACAACAATCTATTGCAAA
TTAAAATACTATCAATTACCATATGGCTTACAACCTAACTAACGAAAGGTAGGTAAAGAA
ATTGCAATTTTTAACTTTTTGCTTTTTTATCCTGTATTTATGTCTATTTACTGGATTGT
CGGTTCAATTTATTTCTATTTTACCAGAGAAATTAGATATTCATTGAACAAGAAGCCTGA
CATAAATGTGGATGAATTAGAAGGCATTACATTTTTACTTGCCTGTTATAACGAAAGTGA
AACGATTGAAGATACGTTGTCTAWTGTTCTTGCACTCAAATACGAGAAGAAAGAAATTAT
TATCATTAATGATGGAAGTTCAGATAATACAGCAGAACTCATCTATAAAATCAAAGAAAA
TAATGACTTTATTTTCGTCGATTTACAAGAAAACAGAGGTAAAGCCAACGCACTCAATCA
AGGCATTAAACAGGCTTCATATGATTATGTAATGTGCTTGGATGCAGATACTATCGTTGA
TCAAGATGCACCATATTATATGATTGAGAATTTCAAACATGATCCAAAACTTGGTGCAGT
TACAGGTAATCCTAGAATTCGAAATAAGAGTTCTATTTTAGGTAAAATTCAAACGATAGA
ATATGCAAGTTTAATTGGCTGTATTAAGCGAAGTCAGACACTTGCTGGCGCAGTCAATAC
TATTTCGGGTGTCTTCACTCTATTTAAAAAAAGTGCAGTTGTCGACGTTGGCTACTGGGA
TACTGATATGATTACCGAAGATATTGCAGTTTCTTGGAAATTGCATTTACGTGGATATCG
TATTAAGTATGAACCGCTTGCCATGTGTTGGATGTTGGTTCCAGAAACATTGGGAGGTCT
TTGGAAGCAACGCGTGAGATGGGCTCAAGGGGGACACGAAGTATTACTACGAGACTTTTT
TAGCACAATGAAAACGAAAGGTTTCCTTTATATATTTTGATGTTTGAGCAAATCATCTC
GATTTTATGGGTATATATAGTGCTTCTATATTTAGGCTATTTGTTCATAACAGCAAACTT
CTTAGACTATACATTTATGACATATAGTTTTTCAATATTTCTACTATCATCATTTACTAT
GACTTTTATAAACGTTATTCAATTTACAGTCGCACTCTTTATTGATAGTCGCTACGAGAA
AAAGAATATGGCTGGACTCATATTTGTAAGTTGGTATCCGACAGTATACTGGATTATTAA
CGCAGCAGTAGTTCTTGTCGCATTTCCAAAAGCATTAAAACGTAAGAAAGGTGGTTACGC
```

TABLE 7-continued

```
AACATGGTCAAGCCCAGACAGAGGGAATACCCAACGCTAAAATCATCGCTAAATATTGTA
AGAGAAACAGCACTTATCGCTATATCTTGTGTCTTTTGGATATATTGTTTAGTTGTTCTA
CTCGTTTATATTGGTACTATATTTGAAATTCATGACGAAAGTATCAATACAATACGTGTT
GCTTTAAACATTGAAAATACTGAAATTTTAGATATATTTGAAACTATGGGCATTTTCGCG
ATTATCATTTTTGTATTTTTTACAATTAGCATATTGATTCAAAAATGGCAGAGAGGAAGA
GAATCGTGAAGTATAGAAAATTTATAATTTTAGTGTTGAGTATCTTGATCATATTGCCTG
TAAGCACACTGGATGGTCATCATATTGCAAATGCAGATGACGATTCACCTAAAAAACTGA
AATATAAAGAAAATAGTGCTCTGGCATTAAATTATCACCGTGTAAGAAAAGCGAATTTTC
TGAATAATTTTATTTACTTCTTTTCTAGTAGTAAAGAAATTAAAAATTATAGTGTTAGTC
AATCACAATTTGAATCTCAAATAAAATGGCTAAAATCACATGATGCTAAATTTTTAACCT
TGAAAGAATTTTTATATTACAAGAAAAAAGGTAAGTTTCCAAAACGAAGTGTATGGATTA
ACTTTGATGATATGGATGAAACTATTTATGAAAATGCTTATCCAATCTTAAAAAAATATA
AAATACCGGCAACTGGGTTTATTATCACAGGTCATGTTGGGGAAGAAAACTTTCACAACC
TCGATATGATTAGTAAAAAGAACTAAAAGAAATGTATAAAACTGGGTTATGGGAATTTG
AAACACATACCCACGATTTGCATAACTTATCTAAAAATAATAAGTCAAAATTAATGAAAG
CTTCTGAAGCTACAATCATAAAAGATTTAAACAAAAGTGAAAAATATCTAACTAAAAACT
TTAAAAAGTCGCAGAAAACTATAGCCTATCCTTATGGCTTGATGAATGACGATAAATTAC
CGGTAATCAAAAAAGCTGGGTTAAAATACGGTTTTTCATTAGAGGAAAAAGCAGTCACTC
CGAACTCCAATGATTATTACATCCCTAGAATATTAATTAGTGATGATGCTTTTGAGCATT
TAATTAAGAGATGGGACGGATTCCATGAAAAAGATTAGACTTGAACTCGTATATTTACGT
GCTATTATATGTGCAATTATTATTATCACACATTTACTTACACAAATTACTTTAAAACAT
GAAAATATGGAGGGTGGATCCTTAGTGTTACAATTTTACATTCGTAATATTGTGATTTTT
GGTACACCTTGCTTTATTATCTTGTCACAGTTACTGACAACCTTGAATTACCAAAAGTC
ACCTATAGATACTTAACTACACGCGTAAAATATATACTTATTCCTTACATATTAATGGGA
TTGTTTTACAGTTATAGTGAATCATTATTAACAGATTCAAGTTTCAATAAACAATTCATT
GAAAATGTCCTATTAGGTCAATGGTATGGCTATTTTATCGTTGTTATCATGCAATTCTTT
ATTTTGAGTTATATCATTTTTAAAATTAACTATAACCTATTCAACAGTAAAATATTATTA
TTGTTATCTTTTATTTTACAGCAATCATTTTTATATTACTTTACGAACAACACAGCGTTT
CACGATACCGTGCTACACTATTATCCATTAAGTGAAAATACTATAATATTCGGATGGATT
TTTTATTTCTTCTTAGGTGCATATATGGGTTATAACTACGAACGTGTATTAAATTTCTTA
GAACGTTATTTAGTTATTATGATTGTATTAGCTGTAGCTACTTATTTTGTGTTTATTGCG
TTAGCAAATGGAGACTATTGGAACGTTACCAGCTTTTCATATTCATTAACACCATATAAT
AGTATTATGTTTATTGTTATCTTGGGTATTTGCACGCATTTTAAAACAATGTTATTTAAT
ACGATTCAAATGATTAGTGCTTTCTCATTCTTTATTTATTTATTACATCCAATCATTCTA
GACTCATTGTTTGCATATACAAATATATTTGAGGATAATACAATGGTCTTTCTAGCGATA
TCACTACTATTCATTTTAGGATTATGTATAGGTGTCGGCATGATATTGCGTGAATTCTAT
ATCTTTAGGTTTATTATTGGAAAACAACCATATAAATTGAACATTAATGCTTATTAATTA
TTAAGCTATGTTAAAAACACGCGGTGGGCGAAATCAGTTTGAATTGACTGACTTCGTTTT
ACCGCGTGTTTAATATTGTTATACATATATTCTAATTGCACATTTAAACTTCGTAAATGC
CAATGGGAGTGGGACAGAAATGATATTTTCGCAAAATTTATTTCGTCGTCCCACCCCAAC
```

TABLE 7-continued

```
TTGCACATTATTGTAACCTGACTTTCCGCCAGCTTCTATGTTGGGGCCCCGCCAACTTGC
ACATTATTGTAAGCTGACTTTCCGCCAGCTTCTTTGTTGGGGCCCCGCCAACTTGCATTG
TTTGTAGAATTTCTTTTCGAAATTCTTTATGTTGGGGCCTCGCCAATGTTTTACTTGAAT
AATTCTTTTAGAATTCTAAATAATGATCCGATTAATTGAAAGAAGTCTGCAGTCATTATT
AATTCCTCCCTTTACTTTATAAATTATGCTTGCTTAGTATCAGTCAGCTTTTCAGTTTTC
ACTAAATCGTCTGCTAAATGATGCCAAAAATCTTGTAATTCTTCTCTTGTGCGCACTGTA
TCAGAACTGTCTTGTCCTACAAAGTCAACATGATCCCAATCATGTTTTGTAGGCGTCACT
TGCCAAATGCCTTTTTGAATTTTATCTGTCGCTTTTGTATAAGCTTGATTAAATGGATGT
TGAGAAGAAATAACGGATACTAAACCATCGTTTTCTCGCCATTCTTTTTCAGTAGCTTTA
CCGATTAAGTTACCAGTAATCACAAATGGGAAAAACATATTTAAGTCTGCTTTTTGTCTA
TCGCTATTTAATGCTTTGTGCGTTGCTTCACCAGTGTATGTTTTATACACAATGTTAGGG
TTCAACGACGTTTTACGATTTAAATCTGTTGCACCCTCACGCGTCAGATCGTAAAATCCA
TTATCTTTTGATTTCCATAAATTAGATTGTTTAACGCGTTTGACATAATCAATATATGAT
TCATTTGGCTTCTGTTTTAGACCCCATTGAGCCAACCCGAAGTCTACTCTTGAATTTTTA
TTACCAAACATTTTACCGATATCAAATACGATTTGTCTCACTAAAGCTTCATTACCAGCT
AAATCTGATGCGTGTGTACCATTATGTGGTGTTCCTAAAGTAGTAATTGATGAAATCATA
TTGTCATGATTACCTTTGAATAGTGGAGAAATTTCGCCACCATGTTTCTTTTGATACTCT
ATTTCTTCACGATTACCATTACGCAGTAATTCTTCTAGTTGACGTATCGTTTGACCGCCC
ATACTATGTCCAACTAGGTGTACCTTCTGTCCTGGTTTCCAGTCTTTGTAAATTCCTTCG
TATGTTTTTCCATAACGTTCATGTCCATATTTTGCTGCATGTGCTGCACCATAATCTACA
CGACCGCCTTTGATATAATAATAAAGTTCAACTGCGCGGTCATAGTTACTTCCAAAAGCA
CTTATACTTGCTTCATAAGCTTTGTAACCATTTTCTTCTAAATCTTGGCGAATGTTCATT
TTATTACCGCCCCAATAATGAGCTAACACTGAAGGATTAATATCATCTGTAAACCCATTG
AAACCATGCACTAAAACGATAGGATCC
LOCUS 66 (E1)
CAGGATTCGTTTTATCTAACTCTTCCCCAAAAGCTGATAAGTGTTGTGTAGTTTGTGTTG
TCATTACAGTAACTAAGATTGCTGTACCTATAGAGCCTGCTAATTGACGCATCGTATTTA
GAAAAGCATTACCATGAGAGGCAAGTCGTCCCGGTAACGCATTAATAGCTGCATGGACCA
TTGGCATCATTATAAATGCCATACCAAATTGAACGAAGTACATAGATACCATGATTGTCA
TATATGGTGTATCCATATTTAATTTAGTTAATTCCCATGTTGCATAAGTCATTACAGCAA
TACCAAGATAGCTAATGGTTTTAAACCAATAGTATCTAACAATTTACCTGCAAATTGGTC
CTAGTAGACCCATAATTAGAGAACCAGGTAATAATAACAATCCGGAATCTAATGCTGAGA
ATCCGCGTAAATTTTGTAAATAAATCGGTAATAAAATCATACCACCATATAAACTTAACA
TTACAACCATATTAATAATTGTTGTTAATGTAAATGTTGGGAATTTCAATACTTCTAAAT
TCAACATTGGTGATTTCATTCTTAATTCTCTAATAACGAATAGAATAATAAAGATAATAC
CAATCGCAAACATTGTTTCTATCTCTACTGAACCCCAACCTTTGTTGCCAGCTTCTGAGA
AACCATATAACAAAGCACCAAAACCAATCGTACTAAAAATGATACCTGGGATATCAGCTT
TAGGGTTTGTTGTATATTGATATAACTTAAACCATACAAAACCAATTAAAATAGCGATAA
TCCCGATAATGAACATACCGTAAAACATCACATTCCAATGGTAATTTTGTACAATATAAC
CTGATAATGTTGGACCAATTGCAGGTGCTAAAATCATTGCGATACCCATTGTACCCATGG
```

TABLE 7-continued

```
CAGCACCACGTTTTTCAGGTGGATAAATTGTAATAATAACAATTGAACCTAATGGCATTA
GTACACCTGCACCAATGGCTTGTAATACACGTCCAACCATCATGATTGGGAAATTCATTG
AAATCGCACAGATTAATGAACCAATTGTAAAGAGTACTAACGCAACTAAAAATAATTTTC
GATATGAATATTTATTAAATAGATACGCCGTAATTGGTATTAAAATACCGTTTACTAACA
TGAATCCCGTCATCAACCATTGCCCTGTTGACGCAGAAATATTAAATTCCGTATTAATTT
TTGGTAAAGCAACATTTAATAATGTTTGGTTTAAAATCGCAATAAACATACCGAATAATA
ATGCCGCTAATATTTTACCGCGTGAAACACCTTCACCAAAAATAAAGTTTTTATGTTCTT
TTTTTATTTTTTCATTCACTTTATATTCTTCTGATTCAGGATTTTTAGCAGCAACTGCTT
CCTCATCCTTATTATTAGTCAATGCTTCTTGATCTTTCTCAGACCCCTTTGTGTAACCAT
TTAGACTAACTTGGCTATGATCATCTTGATTGTCAACACGCAACTCTTCATGCGTCATAC
GTTGTGTCGATTGATCAGTTGTTTTGTCTAAATCACTAGCTTTAAATTTAGATTGATTTG
ATTGACGTGTCGTAAATTGTTGTTCCTTTTGTTGGCGTTTGCCTTTTTTTCTTGATCTTA
TTAAAAATAAATTGATAACCCCAACAATAATCAGCGCTAAAATAATGTAGCTAATAATGA
AGGTCGTAGTCATTTAATGACCCCCTTAATTTTTATGGATTTTTACTTCAGCGTTCATTC
CAGGAACAACTTGTTTAGACGGTTCTGATTCTAGAGTGATTTTAACAGGTATTACTTGAG
AAACTTTAGTGTAGTTACCATCACTATTTGATGATGGCATTAATGAAAAGCTTGCAGCAG
TTGCTTTTCCAATACTATCAACTTTACCTTTAATAGAAGCTTTTTGACCGTCAATAGTCA
CATCAACATCTTTACCTACTTCAACATCTTTAATATCTTTTTCGTCAATATTTGCTGTTA
CATATAAATCATCTAAATTGTATGCATAAGCGATTGGGTTACCAGCTTGCACCATTGAAC
CTTCCATACCATCTAATTTGGCAATTGTACCTTTTTGAGGCATT
LOCUS 67 (F119)
GATCAAAATTTTGAATTAAATACTGTCTCAATTTAAAGTCGAGTTCTTTAAGTGAAATCT
CTTCTTTATAAATGTAGTGTACTCTACCGTACGTAGCAATACCGTCACCTTCATCTCTCT
TGATTTGAAATCTTGGTGCGTTTATATAATCATAATAAGCGTCTTGATTTTTCTTAGTGA
CACCACCATATGAAAACACTGTGCCATTACGGTTTTCCGCTTCTTTAACAACAAATATGT
CTAATCCCGGATTTTTACGTGCTATAAATCTTTCAATATCTTTACCAAATATCTGTACTC
TTGTGAATTTTCTATTTTTATCAAAGATAAGGTAATGCTTGCCACCTTTGCTATAACGAT
AACCAGTAACATTTTTAAGTTCCTTACTTGCGCCACTATAGTAATCTCTTAAGTCAAAGA
TATCTTTTGTCACATTTTCATATTTTGCTTTATGTTCACTCGCATTTACAGTTTGATGCA
ATGACGTTATTGTTCCTGTTGCTAAAATACCTAATGCTAAACTTGCTTTCGCAATTGCTG
TCATTTTCATAGTTGTATGCTCCATTCGTAATTATTAGATTTGTTCGCTTACGTCTATTG
AATCATACAGCTTTATTATAGTTAGCGTATTTGACCTTTCACATTAAACCATGTTTAATA
ATCATTGAATCATTATTAAGTAAATTAAGGAATCTATAATGTTCGTTAAATAAAACTGAT
CCCGTTGTGCTTCACACCCGATAGATAGGGATTTACAGATAAATTCAGGTCTCTTCCACG
TCATATTTGGACCCATCGAAAATTCGGGTTCTCAAATCATCGAACATAACAAAGAAGCT
AAGCAACATGTAGGCCGTTGTCACTTAACTTCTTGTTTTTCCGATGACAGCTTCTATTTA
GAGAATGTCATGATTATTTATATTCACTTCAATGTTATCAATATTAGTGCCATCTATGA
CATCTGCCATGCGATTTTCTTGTAATTTTTTGTGCAATTCAAACGTGTACTTTCCACCGT
TTTTCATTTTAATAACAATTTTACCTGAACCAACGTTACCGTACAGATTATTTTTTTCAA
TAAGTTGTTTTCTCAATTTAAAATCAAGTTCTTTCAAGGAAATCTGTTCTTTAGTAATCT
```

TABLE 7-continued

```
TGAATTCTGAAACATCATGAGAGATTGTACCTTTATTATCTTCCTTAGTAATTCTTACTC
CTGCTTTGTGATCAACTTTTTTACTATTACTCTTTGTGATACCACCGACAGAATATTTTT
CCAGATTGTAATTATTTTCTTCTAAAACGACAAATACATCGACATTCCTATGTACTCCTT
CACCATATTTTTTATCATCTTTACCAACTAAAGCAATTTTATATATGAAATAATCTGGGA
CAACATTCATAAATCTTATTGTCGTCCATTTTTTAAAATAATACCAATCTCATTTTTAA
ATTCTAAACTTGGTTTCGTATAATACGCTCTTAAATCTTTAAATTTAGGATTTATTTCTG
TTGGTACTTGTTTTGTGGTTGGCGATTGTGGTGTGTCTGATTTAGTAGATTGCATTGGTT
GTGGCGTGTTTGTTGATGGAGGTGTTGTCACTTTAGTTGAAGGCGGTGTTGTCGCATTTG
CTGTTTGTTGCGGTGCTTCTACTTTAGTTGAGGGCGGTGTTGTCGCGTTTGGTTTTGATT
GCGGTGCTTCTATTTTAGTTGAGGGCGGTGTTGATTGTGGTGCTTCCACTTTAGTGGAAG
ATAGTGTTGTCGCGTTTGCTGCTTGCGTTGTCGTTGTGATTACACCTGTTGTTAAAAGGC
CTAGTGCTAAACTTGTTTTAGCAATCGTTGTTATTTTCATAGTTGTATGCTCCATTCGTA
ATTATTAGATTTGTTCGATTACATTCATTGAATCATACAGCTTTATTATAGATGGCGTAT
TGCTCCATTCACATTAAACCTTGTTTAACTATATTTGAATCATCGTTAAGTAAATTAAGA
AATCCATAATGTTCGTTAAATAAAAATGATTTTGATGTGATTCAACACTTGGCACATTTG
AAGTTTCGTCACTTTTAAGACATAGAAATGCCACTTTTACAAACAAATGAATATTCGTCT
TTTTACATCATTACGCATAATAAAAGAAGCTAAGCAACATGTAAACCGTTGTCACTTAAC
TTCTTGTTTTTCCGATGACAGCTTCTATTTAGAGAATGTCATGATTATTTTATATTCACT
TCAATGTTATCAATATTAGTGCCATCTATGACGTCTGCCATACGATGCTCTTGCAGTTTT
TTGTGTAATTCAAACGTATATTTCCCACCGTTTTTCATTTTAATAACGATTGTTCCTGAA
CCCATGTTACCGTAAAGATTATGTTTTTCAATAAGTTGTTTTCTCAATTTAAAATCAAGC
TCTTTCAAGGAAATCTCTTCCTTAGTAATCATGTATTCTGAAACATCGCGTGAAATCATA
CCTTGATTATCTTTTTTAGTAATGCTTAATTCTACTTTGTGATTAACTTTTTTACTATTA
GTCTTCGTGATGCCACCGACAGAATATTTTTTCAATTGATATTTATTGTCTTCTAAAACG
ATAAATACATCGATATTATCGTAAGGTCCATCTTTATATTTTTTCTCATCTTTTCCAACT
AAAGCTATTTTATAGATGAACCTATTTGGAATAACATTCATAAACCTAACCGTCGTCCAT
GGTTTGAGCATAAATCCAAACTGCTTTTCAAATTCAAAACTCGGTTTTGTATAATACGCT
CTTAAATCTTCATATTTAGGAGTCATATCTGTTTGTGCTTGTTTTATGGTTGGAGATTGT
GGTGTGTCTGATTTAGTAGATTGCATTGGTGTGGCGTGTTTGTTGATGGAGGTGTTGTC
ACTTTAGTTTTCGGCGTTGTGGATTCGGTTGTCGTTTGTGATTGTTCTTGTTTAGGCGCT
GGCGTTGCTGATATATTAAGCGTTTTCTGCTCTTCTTGTTTAGGTTGTGATATTTTTCT
ATTTTGGAAGCTGAGGTTTTTTCCTCATTAGTATTTGGTGCCTTTTCGAGTTTAGGCGTG
CGTTCTTGTCTTGTGTTAGCTGCTTGTGTTGTCGCTGAATTTGCACCTGCTGTTATGTTT
ATCATTGCTAATCGCTCTGCTTTAAGCGTTGGTACTTTGTCAACTTTAGTTGATTGTATT
TTTTCTGCTTTGACCGATTGCGTCGTTACTGTAATTGCGCCTGTTGTTAAAAGCCCTAGT
GCTAAACTGGTTTTAGCAATTGTTCTCATTTTCATAATTGTATGCTCCAATCTATATTAT
ATTCGATTGTCTTTTTACGTAATTTGAATCATACAACATCATTATAGATGGCGTTCTAAG
ATAATCACATTAAACCCCTTTTAACAATTATTGAAGTATTATTAAGTAATTTAAGCAAAA
AATAATGAGTGAGTATGAGATTAATATAGCGTTTCTATGTGCCTTTGAAATAATTTTTAA
GCATTAAAAAGAAGTTAAGCAACGTTTGATCGTCACTTAACCTCTCTATTTCAATTTCAA
```

TABLE 7-continued

```
CTTATTTCGTCATCAAGTATATGTGTTATGCTTTTATAACTTTGATTTCAATTCTATCAA

TATCTGTGACATTGATAACATCGGACATACGGTCTTCTTGTAACTTTTTATCCAATTCAA

ATGTATACTTTCCATAGTATTTCTTTTTGACTGTAATTTTTCCTGTACTCATTTCACCGT

AAAGACCATAATTATCAATAAGGTATTTTCTTAATTTAAAATCAATCTCTTTCAATGACA

TCGCTTCTTTATCTATTTTAAATGGGAAAAAGTCATAATCAT

LOCUS 68 (G27)
GATCTGCTAATTCGTTTGTATTTTTCACAACAATTTCATGCGCTTTTTCTTCACCTAAAA

AATGAAACTCGTTTAACATTTCATCTGTAGTTCTAAAATGTGCTTCCGGTAAAGTTGAGC

GATTAAGTGGATTGCCGGGTTGTGATGCTATTAAAATTTTACGTGCGATACCATCATGTT

CAAACAAATAGTGTGCATTTCCTGTCGCAATAACAGGTATACCCGCTGTGTCACCTGCAT

GTATTAAACGTTGATAAATTTCATGTAATGTTTCAGTATCTCTAATAAGCTCTCTATCAA

TTAAATCTTGATAAAGTGCCGGTGGTTGAATTTCAATAAAATCATAATATTTGGCAATTT

TTTCAACTTGACTCTGGTCCTTCTGCATAACTGCCGTAAATAATTCACCTTCATCACACG

CTGTACCTACCAATAATCCCTCACGATATTCATCTAACAATGAACGTGGAATTCGAGGTG

TACGGTAGAAATACTTCACCAATGATGCACTTACAATTTTAAATAGATTTTTAAGACCTT

GTTGGTTTTGTACAATTAATGTGACATGACTAGGTCTTGCACGTTTATATGCATCTTCAT

TACTGAGTTTTTTGTTGATTTCGTTATGATTTAATACGCCTAATTCTTTCATTTGTTGAA

CCATTTTTATGAAAATGTAAGCTGTTGCTTCTGTATCATAAATGGCACGGTGATGTTGCG

TTAATTCTACGCCATATTTTTTAGCCAAGAAATTCAAACCATGTTTACCATATTCAGTAT

TAATCGTACGAGATAATTCTAAAGTATCGATAACACCATTCGTTGATGGTCCAAACCCAA

GACGTTCATATCCCGTATCGATGAAGCCCATATCAAACGAAGCATTATGCGCTACGAATA

TCGCATCGCCAACCCATTCTTTAAACTCTGTAAGTACTTCTTCAATCTCAGGGGCATCTA

CTAACATATCATCAGTAATATGCGTCAAATTGATAATCGTTTCCGATAATCGTTCATGCG

GATTACTAAACCTTTCAAACTTATCGATGATTTCACCGTTATGAACTTTCACAGCTGCAA

GCTCGATGATTTTATCATACTGATTTGATAAACCAGTTGTCTCAACGTCGAACACAACAT

AAGTAGCATCTTTTAATACGACATCTTGTGGTTTGTATGCAATCGGAACACCATCATCAA

CTAACATACCTTCCATACCGTATATCATTTTAATGCCATGTTTTTCCGCTGCTGCGTGAG

CATCTGGAAATGCTTGCACAACATTATGGTCTGTAACCGCAATGGCTGGATGTCCCCAGT

CTGCTGCCTGTTTAACATACGCACCAATATTGGGTATACCATCCATTTGGCTCATTGCAG

TATGCAAGTGGAATTCTACACGCTTTTCTTCAGCCTTATCTTTTTTTGTCGCTTTTTTAA

TCTCTTCAATATCAGACATCATCATAACTAAATCTCTAATAAATGTATCTTCTTCAATAC

GACCTTGAGCCCTAACCCATTTACCAACACTTAGCGCTTTAAAATGTTCTAAATCATCTT

TGTTTTTACGAGTAAACATTTTTAAAACTAAAGAGTCCGTATAGTCAGTCACTTTAATTT

CTACGATATGGCGACCACTTTTAAGTTCTTTTAAGTTTATATCAAAAATGACACCCTCTA

TTGCAACTTTAAACTCTTCCTCAATAATAGATTCAATTGGTTTAATATTTTCAATTTGAA

TCGGCTTACCAATTTGACACTTATCGACAGCACTTTCGTTGTTATCTTGTTGTTTCGCTT

TTTCAGCTTTCATTTTTTCAAGTTTCTCTGTTGCCAATCGTGCACTTTGTTCGTCTTCTT

CTTGAATATGTGCTTCTAAAGAAGCTAAGTTTTGTTCTTGATCATTATCATTTGTTTCGA

ATATGATTTTATCGATATCAAAACCACAATTTCTAAACGCTTTGATAAGACTTCCATTAC

ATGCCTTATCAAAATGATTACGTTCAATGTCATTTGATACCATTACTTTTAATACTTTTC
```

TABLE 7-continued

```
CAGACATAATAAGCTTTTTCTGTTTCAATTGACCTTTAACTTTTGGAGATAAAGCTGTTT

GGTCAATACAGTGCCCAAAGTATTTAATTGCATGTTCATCTTGATTCGTGCCATTTGTTA

CCGTAAAACGACATGTAACGTTGGCGATATCTTTAAACTCTTGCTCTATTGCATTTATAA

ATAATAAATAATCTTCATGAGCTAAGAATTGTGGTAATGTAATATGAAATTCCCATGTTC

TGTTTTTGTTAGAAACATCTATACGTGTCAGTTCACCTGAATTTAA

LOCUS 69 (H110)
GATCCAGCGAGTGGTTACGCTAGCATTTTAGGTATCCCAACATTACAAACAGGTGTGTTC

GGCGGTATTATAATCGGGGCCCTGGCAGCTTGGTGTTATAACAAGTTCTATAACATTAAC

TTACCATCTTATTTAGGTTTCTTCGCTGGTAAGCGTTTCGTACCTATTATGATGGCTACA

ACATCATTTATTTTAGCATTCCCAATGGCATTAATTTGGCCAACGATTCAATCAGGATTA

AATGCATTCAGTACAGGATTATTAGATTCAAATACTGGTGTTGCCGTATTCTTATTTGGT

TTCATCAAGCGTTTATTAATTCCATTCGGTCTACATCACATTTTCCACGCACCGTTCTGG

TTCGAGTTTGGTTCATGGAAAAATGCAGCTGGTGAAATTATTCACGGTGACCAACGTATC

TTTATCGAACAAATTCGTGAAGGCGCACATTTGACAGCTGGTAAATTCATGCAAGGTGAA

TTCCCTGTTATGATGTTCGGTTTACCTGCAGCAGCTTTAGCAATTTATCACACAGCTAAA

CCTGAAAATAAGAAAGTAGTAGCAGGTTTAATGGGTTCTGCTGCTTTAACATCATTCTTA

ACTGGTATTACAGAACCATTAGAATTCTCATTCTTATTTGTAGCACCATTATTATTCTTT

ATTCACGCAGTACTTGATGGTTTATCATTCTTAACATTGTACTTATTAGATCTTCATCTA

GGTTATACATTCTCAGGTGGTTTCATCGACTACTTCTTACTCGGTATACTACCTAATAAG

ACACAATGGTGGTTAGTCATTCCTGTAGGTCTTGTATACGCAGTTATTTACTACTTCGTA

TTCCGATTCTTAATTGTAAAATTAAAATACAAAACACCAGGTCGTGAAGATAAACAATCA

CAAGCGGCTACTGCTTCAGCAACTGAATTACCATATGCAGTATTAGAAGCTATGGGTGGC

AAAGCAAACATTAAACATTTAGACGCTTGTATCACACGTCTACGTGTTGAAGTTAACGAC

AAATCTAAAGTTGATGTTCCTGGTTTGAAAGATTTAGGCGCATCTGGTGTATTAGAAGTC

GGCAATAATATGCAAGCAATTTTTGGTCCTAAATCTGACCAAATCAAACATGAAATGCAA

CAGATTATGAATGGTCAAGTAGTAGAAAATCCTACTACTATGGAAGACGATAAAGACGAA

ACTGTTGTTGTTGCAGAAGATAAATCTGCAACAAGCGAATTGAGCCATATCGTGCATGCA

CCATTAACTGGTGAAGTAACACCATTATCAGAAGTGCCTGATCAAGTGTTCAGCGAAAAA

ATGATGGGTGACGGTATCGCTATCAAACCTTCACAAGGTGAAGTTCGTGCACCATTCAAC

GGTAAAGTACAAATGATTTTCCCAACAAAACATGCAATTGGTCTTGTATCAGATAGTGGT

TTAGAACTATTAATCCACATCGGTTTAGACACTGTTAAATTAAACGGAGAAGGCTTTACT

TTACATGTTGAGGAAGGTCAAGAAGTTAAACAAGGTGATTTATTAATCAACTTTGATTTA

GACTACATCCGCAATCATGCAAAGAGTGATATTACGCCTATTATCGTGACACAAGGAAAC

ATTACAAACCTTGATTTTAAACAAGGTGAACATGGCAACATTTCATTTGGCGATCAATTA

TTTGAAGCTAAATAATGCTTACTATAAACAGGTGCGTATACCTTCATAAGGTGACGCGCC

TGTTTTTTCTTTGCTATTGTATTTTGCAGCATCATTGATAGTTCGCTCTCCCC

LOCUS 70 E100
CCTTGAGTATGTTTACCTAAACGTTCTTGAGTAAGCTCATCAGCTTTATTCATCGCTTCA

TTAGTAGCTGCTAACACTAAGTCTTGTAGCATTTCAATATCGTCTGGGTCTACAGCTTCT

TCTTTGATTTCAACGTCGACAACTTCTTTATGACCAGTTACAGTAACTGCAACCATGCCA

CCGCCAGCTGTTCCTACAATACGCTCTTCTTTAAGTTTTTCTTGTTCTTGAGCCATTTTC
```

TABLE 7-continued

```
TTTTGCATTTTTTGCATTTGTTTCATCATTTGTTGCATGTTTCCGCCACCGCGCATATTC
CATTTCCTCCTTGAAAATCAATAAATATTTATCAATAAAATGATGTTTCTTTCATTATAC
ATACGATTATATCGCTTGTCATGTATCACTCTTCATCTATCACATGTACAGTTTCTTCAC
CGAAAAGATCTTTTGCTTTTTGAGCAATATCTGTTTGTTGTGCTTGTTGCTTTGGCATAT
CATCGCCTTCGTTTTTACGATTTTGTAAATATTCCGTTCGAACTCTTTGCCATTGATCTG
ATGGTACACCTACAACTTTAACGTTTTTATTAACGATATTACATACAACACTTTCTATAC
TACTACGTTTCTCGTCGTCTTTATTGACGATTTCACAATGGATCTCTTCCTCAAATTTCA
CAAGTACGTGATCTTCACTTGCCGCCACAGGTTCCGAATTTTGCAATAAACTAACGAGTG
ATTTTTTATCATTATTTTTGGCATGATCAATCACTTCTTGCCAATGATCTTTCAACAATT
TGATATCTGCCTTATTCGCTTTATCTAGCACTTTTGCAATTTGTTGCATTGAAAATGCAT
TTTTAGATTTTTGTATGCCTCTCGCAGGCTTTTTCGAAGATTTTTGAACAGGAGCGACAC
TCACTCCTTGTGCTTTTAGTGTTTTTAGTTCTTGCTCTAACTGTTCCATACGTTGCAACA
ATACATCTGTGTTTGGCGATGAAGCAATTTGTGCTGGTTCAGCTACATTCGCAATCACTT
GTGGTTGACCCTTAATCTGCTCAGCTAATTTTACTAACAACACTTCAAAATGAACGTTTT
GATTCACACTAAAACGAATCGACACTAATGTATCATTAATAAGATCAATCATTTGATATA
ACATATCTAATTCTAAGTTCATCAGTGCTCGATACTCAGTATCTTTCTCAGATGTTTTAT
TCATAATCGTATCTCTGACAAAATAAATCATATCATTTATTAGGCGATTCACTTCTTTAC
CTTCTGTTATAAACTGATGGTATTTTTTAAAAGATGCTTGTACGTCACCTTGTACAATAT
CATCAAACAAGTGATCCAACGCTTCATCATGTACGCTACCTGTGACATTCAACGCATCTT
GCAATGTTAACGTACCATCACCAAATGCAATAGCCTGATCCATAATACTTAATGCATCAC
GCATACCCCCTTCAGACGCTTTAGCGATAAATGCCAAGGCTTCATCTTCACATTCAATTT
GTTGTGCATCTGCTACAAATTTTAAACGTTCAACAATTTGATCTAGGCTAATTGCTTTAA
AATCAAAACGTTGTGCCCTAGAAATGATTGTTGGAGGGATTTTATGTGGTTCTGTCGTTG
CCAATATAAAAATAGCGTGTGCTGGAGGTTCTTCTAACGTCTTTAAAAGGGCATTAAAAG
CACCTGTTGTTAGCATGTGCACCTCATCTATAATATAAACTTTATATTTCGATTCACTTG
GTGCATATTTAACTTTGTCTCTAATATTTCTTATTTCATCAACGCCATTATTACTAGCAG
CATCAATTTCTATCACATCTGAATTAGTCCCCTGCGTAATGCCTTTACAAATATGACATT
CATTACAAGGTTCTCCATCAGTGCTATTTAGACAGTTGATTGCTTTAGCAAACACTTTGG
CAATACTCGTTTTCCCCGTACCTCTCGGACCACTAAAAATATAAGCATGCCACTGTTTTT
CTTTCGAAATCGCATTGCGCAATGTCTTCGTGACATGTTCTTGTCCGACGACATCCTCGA
AACTTTGGGGTCTGTACATACGATATAAGGCTTGATAATTCAAGTTAGCACCTCCATAAA
CAATTACCTCTCATTATAGCATGATAATACCTTTACTTCTTAATTGAACAATTAATAAAA
ATGTTGTGGAAATTTTACGATTCCGTGTGGTGCATCCGTCAAATTATCCCATAAATATTT
TACAAGTAACGGTGCATCACCAGATTCTAATTTAATGTCATGCTCAGCAGCATTTTGATA
ACCCAACTTTTCAAAGTAGTCAAAACAATGGTCTACAACAACCGTACTATACTCTTGTGC
TTTGGCACGCTCTTCTACTGCTTGAACCAAGCCACGACCTAATTTTTGTCCACGTAATTC
AGGATGAACTCATAAAGAGGCAATCGCCAAACCATAATACGTCTTATCATCACTATTAAT
TTCTACTTCAATTAATAAAACGTGTCCAACGACATCGTTATTTTCATTTTTCGCTATTAC
TTCTAATTCAAAATTATAGCAAGGAGATTTTCTTAAATGTTTTACTTTCGCACGTGCTTG
CCAACTCGTTTCAGGATTATCATCAAAACTTTCTTCAATACTATTTAAAGATTTATCATA
```

TABLE 7-continued

```
ATCTAACTCTGTTAAAGTACTTAAATATATTTGCATATGTCCTCCGTAGGCATTTGATTG
TCAATAATCATAACGTATCTCATTAATAATTCTATTGTAAGATACTCCCCCTCATTTCAC
CATCATTTCTTTATCATCAAATTATAACTTCTTACTTTTCATTGACACAAAAATCATTCA
AACTGCACATCGAGTTCACTTGAATCAAACTTCACATATAAAAAAGCTACTTCCCACAAA
CATGTTCCACGTATAATACGCTGAATTGTCTTCAAGAAAGTAGCTTCTATAATTATATAT
TTTCAACTCTTAATAATCGGTTTAATATTTAAAAAATAAAAAACCGTGCACCTAAGCATC
GAACGTAATTCACGAACGTAACCAAAGTCGTTAGCTAAATCTCGGCTACCCTACGGCACA
TATGATGATCCACTTAATGCTGCTTCCGTCAGGACCTGACATGGTTCATGGGTTCATATT
GCATAGGACCGAAATCTTCAAACACTACGTGCTTTGGGCAGACTTCGCAAAAATACGGCC
TCAACAAAGGAATTAAGCCTCGCATAAAGCGGATTTCGAGTACAGGGAACCGCTACCTCC
CCACCTAGCACGGCAAGATATATATTACTATATTTTAATAGTTAATTGCAAGTATAAATC
ATTTATATCATTGTTTACTTTATACGACGTCTTGAGAAGTCATTAAATTTAAATTCATTT
GCAAGATGTTTTGAAATATTATATTGAAACGGCATTGTATTTTCTAAATACACAATACTT
CGACTGTTGCTGAATAAGCCACCGATACATCACCAAACAATTGATATGCTTGTTCATCA
AACGGTTCAAAAGTAATAGACTTACTTGAATAACTAATATTAAGATTTAATACCTTTTCC
AAATAATCATAAATAGAATCACTCGCAACATCATTACCTAT
LOCUS 71
CTTCTAACATATTAACCCACTCGTTTGTAGCAGCGTTAAAACCAACACCCGGCTCTGCGT
TTTTCAAACGTTCTACAATAACAGAACCTTCTAATCCTGCATTTTCAGCAATTTGACGAA
CTGGTGCAGTTAATGCTTTAAGTACAATATTTACACCTGTTTCAATGTCACCTTCAGCTT
CAATTTCACTTACTTTTTGGTAAACATTTACTAATGCAGTACCACCACCTGCAACAATAC
CTTCTTCAACTGCTGCACGTGTAGAATTTAATGCATCTTCAATACGTAATTTACGTTCTT
TAAGCTCTGTTTCACTTGCTGCACCTACTTTGATAACTGCAACACCACCTGCTAATTTAG
CTAAGCGCTCTTGTAATTTTTCACGATC
LOCUS 72
CTAATAAATGCACCCTTTTGTAACCAATCATATTCAATGTATGGTTGATCCGTTACGGTA
CATGTAATGACTACTTCACCATTTGATACTGCTTCTTTAGCATTTTCTGTCGCAATAAAA
TTAATTTCCGGACGCTGTTGTTGCCATCTATCAACAAAGCGTGCACATGCTTCAGAGAAT
TGATCGTAAACAAACACGCGTTCAATATGATCGAATTGCTCTAACATACTTTGTAATTGC
TTGTCTCCGATTAGCCCGCATCCAATGATTGTTAAGTCTTTAAATCCTTTTTTAGCCAAA
TGCTTTGCTGCAATCACTGAAACTGCTGCAGTACGCATACTACTAATTAAACTTGCTTCC
ATAACTGCAATTGGATAATTCGTTTCTGGATCATTCAAAATAATGACGCCACTTGCACGC
TCCATATTACGTTTCGATGGATTGTCGTGCTTACTACCTATCCACTTAATACCTGAAATT
GCGTGTTCACCACCGATATGACTTGGCATTGCAATAATTCGATCTGCGATGTGTCCATTT
TCAGGATCCTGTCTTAAATACGGCTTAAGCGGTTGTACAAAATCATTGTGCGCATGGGCT
GTTAATGCTTCTGTTAATGCGTCCACATAAACTTGTGAATGATTACCTCCCGCTTGTTCA
ATATCTGATCTATTTAAATACAACATCTCTCTATTCATTCTGATTTAACTCCTTGTCTTG
ATTTCATTTTTTCTAACCATGTATCTGAATAAACTAAATCTAAGTAACGATCGCCTCCGT
CTGGTAAAATCGTGACAATTGTTGCACCTTCTTCAATTGACGTTATCAACTGCTCAATCG
CTGCAATAATCGAACCTGTTGAACCTCCGGCAAATATGCCTTCATAATCAATCAGTTTTC
GACAGCCCAAAGCAGATTGATAATCATCTACATGGATCACTTGATTAATTTCTGATCTAT
```

TABLE 7-continued

```
TCAATATTTCGGGTACACGACTAGCACCGATACCAGGTAATTCTCTATTAATAGGTTTGT
CACCAAAAATGACTGACCCTTTCGCATCAACAGCAACAATTTGTGCGTTTGGATGCACTT
CTTTTATTTTTCTACTCATACCCATAATGCTACCTGTCGTGCTGACTGGCGCGACAAAAT
AATCTATAGGTTGCTTAATTGTTTCAACAATCTCTGTGCCTGCACCATGATAATGGGATT
GCCAATTTAACTCATTCGCATATTGATTAATCCAATATGCATCGTCAATAGTGGCTAACA
GTTCTTGCACCTTTGCAATACGAGTCATTAAATAACCCCCATGTGCATCAGGTTCTTCAA
CCATTTCTACATTGGCACCATAACTTTTAATAATTTTCAAATTTGTTGGTGATATTTTAG
GATC
LOCUS 73
ATCTTGTAATTCTTGTGCCCCAACGTTTGATGTCATTATGATAATTGTATTTCTGAAATC
AACTGTACGTCCTTTTGTATCTGTCAAATGTCCATCATCTAAAACTTGTAATAGAATATT
AAATACATCTGGATGAGCTTTTTCAATTTCATCAAATAAAATTACAGAATATGGTTTACG
TCTAACTTTTTCAGTTAATTGTCCACCATCATCATGACCAACATATCCTGGAGGAGCACC
AACTAATCGGCTCACTGCGTGTTTTTCCATAAATTCACTCATGTCTACACGGATCATCGC
ATCATCATCGCCAAACATTGATTCAGCTAAAGCTCTAGCTAATTCAGTTTTACCAACACC
AGTTGGTCCAAGGAAGATAAAGCTACCAATTGGTCGTTTAGGATCTTTTAACCCTGCACG
GGCACGTCTAACCGCTTTACTGATTGAATTAACAGCATCTTTTTGCCCAATAACTCTCTC
ATGTAATGTATCTTCTAGACTAAGAAGTTTTTCAGATTCTGTTTCATTGATTTTAGTTAA
TGGGATACCTGTCCATCCTGCAATAACTTCAGCAATATCTTCTTCTGACAATGAAGTTGA
CATGCCATTTTGTGCATTCTTCCATTCATTTTTAGCTTCTTCATATTGCTTTTCAAGTTT
TGTTTGTTTATCACGCAGGTTAGCAGCATTTTCAAACTCTTGAGCATGTACTGCGGCATC
TTTTTCATTTTTAACTTTTTCAATTTCTTGTTCAATTTCTTTTAAATTATTAGGTGTCGT
ATGACTCTTAAGTCTTACTTTAGAACTTGCTTCATCAATTAAATCAATTGCTTTATCTGG
TAAGAAACGATCTGAAACGTATCTGTTACTTAATTTAACAGCTGCTTCAATAGCTTCGTC
TGAAATATTAATACGATGGTGTGCTTCGTAACGATCTCTTAATCCTTTTAAAATAGCAAC
TGTATCTACTACTGAAGGTTCATCAACTTGTACAGGTTGGAAACGACGTTCTAAAGCCGC
GTCTTTTTCAATATTTTGCGATATTCATCTAATGTAGTAGCACCAATACATTGTAATTC
ACCACGTGCTAATGCCGGCTTCAAAATATTCGAAGCATCGATAGCACCTTCAGCACCACC
AGCACCAACTAAAGTATGCAACTCATCAATAAATAGGATCAGATTACCTGCTTGTTGGAT
TTCTTCCATAACCTTTTTCAGACGCTCTTCAAATTCACCACGATATTTAGTACCTGCAAC
TACTGTTCCCATATCTAAAGACATAACACGCTTATCTTTTAATGTCTCTGGTACCTCATT
ATTCACTATGGCTTGCGCTAAACCTTCAGCAATAGCAGTTTTACCAACACCTGGCTCTCC
AATAAGCACAGGATTGTTTTTCGTACGTCTACTTAATACTTCAATTACACGTGTAATTTC
TTTATCACGTCCTATAACAGGATC
LOCUS 74
TATATAAATGATCATTTCAAATGATATAAATATTGTGAGAGTGATACAGAATTGATAGAC
AATGCTCACCTGTATATGATGACATGAAGCATTTTAAAACTACCGCAATCTCAACATAAA
AATACCGAGACTTCCAAATAGAAACCTCGGTACATTTACTTCAATTATATTTATACATCA
TCATAGCTGACTTCTTTTTCAGCTACAGTTTTACCGTCAACTTTAACAATATAACTTGCT
GTTTTTCCTTTTTCAATTCTTAAAGGAATGTCTATACGTTGATCACTAGTAATATCGAAA
CTACCTTTTTCAGTTGAACCGTCATTATCTTTATCTTTAATATAAACTTTAACTTTTTGT
```

TABLE 7-continued

```
GACTTATCATTTTTACCAGTGTATGGTACATCTACCGATTCAGTTGTCGTTTTGACATCT
GATGAGTCACTTTTTTTACCTTTAGAAACAACAAATGAAATCGTTGACCCCTCATCTACT
GATTTTCCTTTAGGAGATTGAGAAATCACATCACCCTCATCAATATCGTCACTATACTCT
TCCTTACTTTCAACTTTAAACCCTTTTTCTTCTAAGGCTTTTTTAGCTTTGCTAAAGGAT
TTATGTTCAAAGTCTTCTACATAAACTTGCTTAATGCCTAAAGATTCATATAGTTTAATA
TTAGAATCATGAATAGCGATTTCAGTATTTGCGGTTACACTTTGATTTGCAATGTATCCT
TTTGGCGCTTGATTATTATATACTTTTTCAATCGTAACATCTTTAAGACCTAACGATTTT
AATTTCTGCAAGGCTTCCTCCTTAGGTAAACCAATGACATTTGGCATTTTAACCTTTTCA
GGGCCCTTTGATATAACAACATCAACACTGTCACCACGTTCAACACGTTCACCAGTATTA
GGAGTTGTCTTAATAATTTCATTTTCAGGATATTTATCACTATAACTTCTAGAAATTTTA
CCCAATTTCAGGTTGTTTTTATTGAATATTTGCTCTGCTTCTTTTACAGATTTCCCGATT
ACATCAGGTGTCTCTTCGTATTTATTACCAAACATTGCCATTGCCACAAAAGAAACAAGT
GCAATCATTAACAACGAAAAGATTAGTGATAAGAGCACAATCTTTCGTGTTGATTTCTTT
TTAGGTTTTGGTTCGTACACCGTACCTTCTGGCTTTTGGAATTGCTGATGATGAGCAGGC
CCATTTACAATAGGTACTTGCGTCGTTTCACGTTTAGGTTGATTCGACTTATGTTCACTA
ATATGCTTTGCTAGATCTTCTTTTTTCAAAGGTACCGCTATCGTTTTCATTTTATCGAGT
TCATAGACATCTTCATTCGCTCGATTTTCATGTAAAACACTACTCAAATCATCTTTCATT
TCTTGAATTGTTTTGTAACGATTCGCTTTGTCTTTTTCTGTAGCGCGTAAAATGACATTA
CTTAAAGATTGCGGAATATCCTTACGTACATCTGTTGTCACATTTGGCACAGAATCCTGA
ATATGTTTAATCGCAATGCTAACTGCAGTTTCTCCATTAAAGGGTGGTTCACCAACAAGC
ATTTCATATAACACAATACCTATAGAATAAATATCTGTACTTCATCCGTTGCCTCACCCT
TTTGCTTGTTCTGGCGAAAAGTACTGCACAGTACCTAACACATGATTAGTCTGAGTTAAA
GACGTCTCACTTAAAGCTTTAGCAATTCCAAAATCAAATATTTTCAACGTTTTATTGCTG
TCAATTAATATATTTTGTGGCTTAATATCTCTATGTACAATACGCATATCATGCGCATGT
TTAATGCCATCCAATATTTGATTCGTAAAATTAATCGCTGTGTCAACACTTAATGCCCA
TGACTTTCAATATACTCAGACAAAGTCGGACCTTCGATATATTCCATTACTAAGTAGTAA
CAGTCATCTTCTTCATCAACATCGATCATACTTACTATATTTTGATGTGATAGCTGTGAT
GAGTTATGTACTTCTCGTTCAAAACGTTTTAATGTTTCTTCTTTTTCTCTAGGTGGTATA
AAAATCGCCTTAATTGCAACTTTAATGTTAAGTATCGTATCTTCAGCAAGATAAACGGTA
CTCATGCCACCGCCGCCAAGCTTATCTACAATTTTATATCGTTCATTTATTATTTTACCT
ATCATACTTTATCACCTTCAATAGCCGCGAGTATGAAAGTAACGTTATCTTTCGAATGGT
TATCTAATGCCAATTGCATTAATTGATC
LOCUS 75
TAGGTCCTCATCAGCAATCGCTTTTTCAATTTCTGGTAATAAAGGACCTGAATTACCGAT
ACAAGTTGTACATCCATAACCAACCAAGTTGAAGCCTAAATCATCTAAATAAGGTTGTAA
GCCAGCATCTCTTAAATATCCGGTAACAACTTTTGATCCTGGTGCTAGAGAAGTTTTAAC
GTATTCAGGAACTTTCAAGCCTTTTTCAACTGCTTTTTTAGCAACTAAACCTGCACCTAA
CATTACATAAGGGTTAGATGTATTTGTACATGATGTAATTGCTGCTATTGCAATATCACC
TGTTTTCATTGTAGCTTTTGATCCATCTTTAAAGTTAATTTCAGCTTTCTTATCAAATTC
ACTTTTATCTAAACCGTGTCCTTGGTTGCCTGCTGGAGCTGTTACAGAATTTTCAAATGA
```

TABLE 7-continued

```
TGATTTCATATCACTTAAGAAAATTAAATCTTGAGGACGTTTTGGTCCTGAAAGCGATGC
TTCAACTGTTGATAAATCCAATTCGATAACATCTGTATAATTAGGATCTTCTTTCTCAAC
ATCAAAGAACATATGGTTTTGTTTCAAATATTCTTTTACTAGCGCGATATGTTCGTCTGA
TCTACCAGTTAACTTCATATATTTAAGAGATTCATCATCAACTGGGAAGAATCCGCAAGT
TGCTCCATACTCTGGTGCCATGTTTGCAATTGTAGCACGGTCTGCTAGTGGTAAATGTTG
TACACCTGGACCAAAGAACTCCACAAATTTACCAACAACACCTTTTTTACGTAGCTCTTG
AGTTACTCTTAACGCTAAATCAGTTGCTGTTGCGCCTTGTGGTAATGAATTTACTAGTCG
TACACCAATAACCTCTGGAATTGGGAAATAAGAAGGTTGTCCAAGCATTCCAGCTTCAGC
TTCAATACCACCAACACCCCATCCTAGTACGCCAATACCATTTATCATTGTTGTATGTGA
ATCAGTACCAACTAATGTATCTGGAAATGCAGTTTTTTCACCATCTACATCACGAACATG
TACAACACTTGCTAAATATTCTAAGTTAACTTGGTGAACATTCCAGTTGCAGGGAGGAAC
TGCATTGTAATTATCAAATGCTTTCGTTGCCCAATTTAAAAACTGATAACGTTCATAGTT
ACGTTCAAATTCTAATTTCATATTACGTTCAAGAGCTTCTGGATTTGCATAGCTATCCAC
TTGAACTGAGTGGTCAATAACTAAATCCACCGGTACTTCTGGATTAATTTTAGTAATATC
TCCCCCAACGTCATCCATTGCTTTACGTAAAGAAGCTAAATCAACTACGGCTGGTACACC
TGTGAAATCTTGTAAAATAACACGAGAAGGTTTAAATGGTACCTCGCCTTCATTTCCATC
TTTTCCAAACTGACTTAAAGCTTTAATATGATCGTCTGTAATTACAAAATCATCTTCTTG
ACGAAGTAAAGATTCTAACAAAACACGAATTGAATAAGGTAAATTGGAAACTTTAGTAAT
ACCTTGCTCTTCTACAGCTTTTAAATCATAGTAAGTATAACTTTGGCCATTCAAGTCAAA
ATGTTTTTTGATTGCTCTTTAAAATTTGCAGCCATTTAATGATCC
LOCUS 76
TGCGTTCTCTTCAACACATGGCGCATCATCTTCTAAATGACTACCCATAAATTGTTTAAC
AAATTCACTTTGAGGATTATTTTTAAATCCTTCTGGTGTGTCAATTTGTTCAATATGCCC
TTCATTCAAAAGACAAATCTTATCACCAAGTTTCATCGCCTCTTGAATATCATGTGTAAC
AAATATGATTGTCTTCTTAATTTTAGTTTGTAATTCAATTAAATCATCTTGAAGTTTTTC
TCGGCTGATTGGGTCTAATGCACTAAACGGTTCATCCATTAAAATAACTGGTGGATCAGC
TGCTAACGCACGTATAACTCCTACACGTTGTCGTTGCCCCCCTGACAATTCATCAGGTTT
TCTGTTTTTATATTTTTCAGGTTCTAATCCAACCATTTCAAGTAATTCATCTACTCTTTT
ATCTATATCTTTTTCTTTCCACTTTTTCATTTGTGGCACTTGTGCAATATTTTCTTTGAT
TGTCATATGTGGGAATAATGCAATCTGCTGCAATACGTATCCAATATCCCAACGCATTTC
GTATACTGGATAATCACTTATTGGTTTATCTTTAAAATAAATATAACCTTCACTTAAGTG
AATGAGTCGATTAATCATTTTTAATGTCGTAGTTTTTCCACAACCTGAAGGTCCAATTAG
CACAAAAAATTCACCCTCATTAATATTGAAACTAATGTTATCGACAGCAACATGTTTGCC
ATAACGCTTAGTTACATTTTTAAACTTAATCACTTTGCCACCTCTTTTTTTCTCATAGCA
TAAAACCGAGATTATATGTATGTATTCCCTATTTAACCACGTTTATTACAATTTTCAAAT
TTAAATGATTTATCCTTGAACTTTTTAATAAAATAATGAATAATAGGTAATCTCCAGTT
AAGAAATAGTGTTATTTTACCTTGAATTCAAAAAAACACCCAGTAAAACAAGGAATGCTT
ACTAGGTGTCTTCACTATACTTTGGCTTTATAATTTTGAATCGTTTCTAAAAATGCTGGA
CAATAATGTTTTAATTTGTAACTACCTACGCCATCAATATTAATCATATCTTGTTTCGAA
GCAGGCTTACGTTTAGCAAATTCCTCCAACGTGTAATCAGAAAATATACTTACAGGTGCT
```

TABLE 7-continued

```
ATCGTTAATTTGTCACTTAACTTTTTACGAACTTCTACCAACTGACTGAATAATACTCGG

TCAACCCCTTCAACCGTATTTATAAATACTTTTTCAGTCGCTTTTTGCTTAAATGGTGTT

GTGAATACTTCTACTTCATTACTGAGTAATTTTTTAATTGAAGTATCACACATTAATATT

TCGTCATTTTCATTTAAGAACCCTTTGAATCTTAATTCATCTATTAAGTGACTTAATTCT

GATGTTGTGTAACCTTTCATTAAACCATG
```

LOCUS 77
```
TGGACCTGTTAATCCAGAAGTCGGCAATATGTTTAACTTCACTGAAACGTAAATAATAAG

TATTGAAGCTATCCAATATGATGGTAATGCAGTTAGAAAGAAAGCCACTGAACGTATCGC

ACGATC
```

LOCUS 78
```
GATCTTCAGCTTGATGTTTTCGTTTGATTAAATTGGTAAAATAGAA

ACGCAATCCACAAAAATGGCAAGCACTAAAATAATGTTTGGGGGTGCTTGTGCTTTTGTG

GATTGCGGTCGATTATTTATATTGCATGATTTGATTAATTTGATTGATTATATTGGACAT

GATGGTGTTGGCGGGATGCGTTGTTGCTAGTCGCGGGCTTTGTCCACTCCACATATGTAT

TAACTCTTTGTCGCCGATGTTTGCTGCGGCTTTTCTTATGCTACTTGTTAGCTCATTTTG

TATTGGATAATCTGGGATATCGCCTTCGTATTGGGACATTTCTTCGATAAACCTATTGTT

GATACCGCGTGCAAGCTTTCCACTAAACGCTTTTGTAATGACTGTATCTGTTTCTTTACT

ATTTATAATTGCATCTCGCAGTAGTTCTGATGCATTACTGTCTTGTGATGTTAAAAATGC

GGTGCCCATTTGTACCCCTTCTGCACCTAAGACAATACTTGCCAAAACTCCTCTACCATC

CATAATTCCACCAGCGGCAATGACCGGAATTGAAACGACATCTACAATTTGTGGCACTAA

AGATATTGTTCCAACCATAGGTAATTGATTTTTAGGTTTTAAAAATGAACCACGATGTCC

ACCTGCTTCACTACCTTGAGCAACGATAGCATCCATACCCGCTTTTTCATTCGCAATAGC

TTCATCAACACTTGTTGCTGTACCTATAAGTTTGACATTCGCTGCTTTCAACCTGCTTAT

AATCTGTTCGCTTGGAATTCCAAAAGTAAAACAACATACAGGCACTTGCTTTTTAATTAT

CGTATCAATATGACACTTAAATTGTTGTTCTTCGGTAATTTTTACAACCGGCTCTTCTAA

ATGTAATGCGCGTCGATAAGGTTTTAACCATGCATTCATATTTTCAATTTGACTACTGGT

ATATGATTGTTGACTTGGTACAAAGACATTTACGCCAAAAGAATTTGACGTTAATTGGCG

TACATAATCTATTTCATCTTCCAATTGCTGCGTATTAAAGTAACCTGCGCCTATTGTGCC

TAACCCACCACTGTTACTTACTGATGCAACTAATTTCGGTGTCGTACTTCCTGCCATACC

TGCTTGTATAATTGGATATTCAATACTTAACATTTGAGTAAGTCGATTCTTATTCCACAT

AGCTGTTCGCTCCTTATATAGATACGTTGCGATTTTTCCGTTGTTGAAATTGAATTTGCT

GTTGAGAAAGTTTTTCTTTTTCCTTTTTATCCATCTCATCTTCAATTTCCATACCTAATA

ATTCTTCAATTAAGTCTTCATGTGACACTATCGCTTCAGTACCACCAAATTCGTCCAACA

CAATTGCTAAATGTTTTCTAGAAATAGTCATCTTACGTAATACCCATTCAGCTTTATTGT

GTTCATTCACAAATAATGGCTTAGCTGAATAGTTTGTAATTTGATTTTCTTTTTTATTAC

TCCAAGCCAACAGATATTTAGAATGAAACACCCCAATAATGTTATCAATATCTCCCTCGT

ACACTGGATATCTAGTGTATGGCTTATTCATAACCGTTTCATAAACTTCTTCGTATGTCG

CATTTGAAGCAAATGCCGTCACATTAATTCTAGGTGTTGTATCTACATCTTTTACTTTTA

AATTTTCAAAATTAATGACACCTTCCAACCTACTCGTCTCAATTTCATTTAAAGCACCTT

CATGTCCAGCAATTGCTAACATTGTTTTAAATTCTTCTTTTGAAAATTGATGTTCTTGAG

GTTGGCCCTTAGATAAACTTCGATTAATACTGTCCGTCAACTTATTTAAAAGTAATGTGA
```

TABLE 7-continued

```
TAGGACGGAACACAATGACACAAATATTAATAATTGGATATACAAGCCTTGTTATTTTAT
CTGGAAATGTTGCAGCGACAGACTTGGGAATCACTTCGGAGATCAAAATGATAACAACTG
TTAAAACAGCTGATGCAATACCAACGCTAATCCCCCAACGTAAAGCCATAATTGTAACAA
GTGTTGGTAATAAAATATTCGCGACATTATTCCCAATTAGAATCGTTGTAATAAACTCAC
TTTTAAATTTTGCTTTATTGGCAGCCGTTAATGCCGTCTCGCTTCCTGAAAAGAAAAACG
AAATAAATATCAATATAATTATGGCAATGATC
LOCUS 79
GATCTTCAATTTCACAAGGAATCCATGATTGAATTTGCTTTAATGTAACATTAATCATAA
TAACAACCTCAGTTAGTCAATTTTGTATTTATTTTTCTGTTTATCCTGGTGACGTTCTTT
AGCAAGCTCGATAAGTTTTGTAATCAATTCTGGATAAGATAAGCCCATATTTTCCCATAA
CTTTGGATACATACTGAAAGCCGTAAATCCAGGCATTGCATTTGTTTCATTAATATATAT
TTGGTTGTCTTCTGTTACAAAGAAATCAGCACGGACTAAACCAGAACAATCTGTCGCTTT
GAATGCCTCTAATGCCATATTTCTAAGCGTTAATTGAACATCTTCGTCTAAGTCAGCTGG
AATTTGTAATTGAACCTTACCATCTTTATATTTTGATTTGTAATCGTAAAACGCGACATC
TTTTACGACTTCACCTGGCCATGTCGCTTCAGGATAGTCATTTCCTAAAACTGCTACTTC
AATTTCACGTGCGTTAACGCCTTGTTCTATAACAAGCTTACGGTCAAATTGGAATGCTTC
TTTAATACCTTCTTTAAGTTCCGCTTCATTATTACATTTACTGATACCTACACTTGACCC
TAAGTTAGCAGGTTTAACAAAGACTGGGTAATTTAATTTATCATTTACTAATTTTAAAAT
GTTATGTTCATATTTTTCATATTCAGAACGTAAGAAACTAATATAAGGTAACTGTGGTAA
CCCTCGATGTTCAAATAATTGTTTCATTACAAGTTTGTCCATAGAACTTGCAGCTGACAA
TACACCATTTCCTACATATGGTACATCCAAAACTTCAAAAAGCCCTTGAATCGTGCCATC
TTCACCATTAGGACCATGTAATAATGGGAATACTGCATCGTATGGTTGTCCTGAACTACT
TTCTTTCAATAGCTGTGAAATCTCAAGCGCCTCTCCATTTTCTAAATGAAGCTCATCAGT
AGATTTAATTTCAGCTGTAATATTATTTTGCTTTCTCCAATCACCATCATTGGTAATATA
AATGATATCAACATGATATTTGTCTTTATCTATTGCATTTAATACATTTTGTGCTGTCAG
AATCGATACTTCGTGTTCTGCACTTTTCCCTCCAAAAACGATACAAATATTTTCTTTTGT
CATTTCGTTTTCCTCCAATGATATATCAGGGTTTGCTACCTTAATATAAATTAATATTGA
TTTAGTCCTATTGTTAATTGATTTATTCGCATCTTTGAATCTTAATAGTATCACATTTTA
ATGCTATTTTGCATTTAAAAACGAGGACTTATGTGTCTGTATCTATGTTGATTCATTTA
TAATCAGAACAATATTCCCTTCTATTTTATTCCTAATTCAAATTGAAATCTATAGCTGAT
ATCACTGTGATATTCTAGCTAATTTTTAAAAAGTCATGTAAAATTGATATAAACATTAGT
GAGTATAAAAGGAGTTTGCAATGAATTATTCATCTCGTCAACAGCCGGATAAGCATTGGC
TTCGCAAAGTAGACTGGGTATTAGTAGCCACTATAGCTGTTTTAGCAATTTTCAGTGTTC
TGCTTATTAACTCGGCAATGGGCGGTGGTCAATACAGTGCTAATTTCGGTATCAGACAAA
TTTTTTATTACATTTTAGGTGCAATTTTTGCAGGTATCATCATGTTTATTTCACCTAAAA
AGATTAAACATTATACATATTTATTGTATTTCTTAATCTGTCTATTATTAATAGGCTTGC
TCGTTATTCCTGAGTCACCTATTACACCTATTATCAATGGTGCCAAAAGTTGGTACACGT
TTGGCCCTATCAGTATTCAGCCATCTGAATTCATGAAAATTATTTTAATTTTAGCATTAG
CGCGTGTCGTTTCTAGACATAATCAATTCACATTCAATAAATCATTCCAAAGTGATTTGT
TATTATTTTTCAAAATTATTGGTGTCTCGTTAGTACCAAGTATTTTAATATTACTGCAAA
```

TABLE 7-continued

```
ATGACCTAGGAACTACATTAGTATTAGCTGCTATTATTGCAGGTGTGATGTTAGTAAGTG

GTATAACATGGCGTATCTTAGCACCTATCTTTATTACAGGTATTGTTGGTGCAATGACAG

TCATTTTAGGTATTCTATATGCACCCGCATTAATTGAAAATTTATTAGGTGTCCAACTGT

ATCAAATGGGACGAATCAATTCATGGCTTGACCCCTATACATATAGTAGTGGTGATGGCT

ATCATTTAACTGAATCACTTAAAGCTATCGGTTCTGGACAGTTACTAGGTAAAGGATACA

ATCACGGTGAAGTTTATATACCTGAAAATCATACTGACTTTATCTTTTCAGTGATTGGAG

AGGAACTTGGCTTTATCGGTTCTGTCATATTGATCTTAATATTTTTATTTTTAATCTTCC

ATCTAATAAGATTAGCTGCGAAAATTGAAGATCAATTTAACAAAATCTTTATCGTTGGTT

TCGTCACTTTACTTGTGTTCCATATTTTACAAAATATTGGTATGACAATTCAGTTGTTAC

CAATCACTGGTATTCCATTACCATTTATTAGTTATGGTGGTAGTGCGCTATGGAGTATGA

TGACTGGAATAGGTATAGTCTTATCAATTTATTATCATGAACCAAAACGATATGTCGATT

TATACCATCCAAAAGTAATTAATTTAAACTATTTTGAGTTTCAAATATCATAACTTTTC

AAGATGACGTTATATAGTCTATTTACGTCGTCGATTTAAAATGTCATATATAGATATTAC

TCGATAATAACAATCCCTCTTTGAAGTACACATTGTAAAATGTACACTCTAAAGAGGGAT

TTTGTTATATAGTACTTGCTTTCATTTTAGTAAATCCAGTCAAAAAGCTATCATCGAAT

AGTCCGACGATAGCTTTAACGGTGTGTGATTCACAATCACAGTCAATTATTTTAATTCGT

GACTTACTTTATTAGATGCTGGCAAAGTATTAATAATGTCTAAACGAGATTTAGTTTTTT

TAATATTCACACCTAATGATGACAATAGTTTGACTACATTTTGAATCTTTTCAGGACGTT

TCATTATTATCACCTCGTTTGGATC

LOCUS 80
GATCATGGCA

TTGTATTTAATGCAAGTCTACCTTTGTACAAAGATGCCATCCATCAAAAAGGATCAATGC

GCAGTAATGACAATGGTGATGATATGAGTATGATGGTGGGTACAGTGCTGAGTGGCTTTG

AATATCGAGCGCAAAAGAAAAGTATGATAACTTATATAAATTCTTCAAAGAAAATGAAA

AGAAATATCAATATACAGGCTTTACAAAAGAGGCAATTAACAAGACACAAAATGTCGGAT

ATAAAAATGAATATTTTTATATTACATACTCTTCTAGAAGTTTAAAAGAATATCGAAAGT

ATTATGAACCACTGATTCGAAAAAATGATAAAGAATTTAAAGAAGGAATGGAACGAGCAA

GAAAAGAAGTGAATTACGCTGCAAATACAGATGCTGTTGCTACACTTTTTTCTACTAAGA

AAAACTTTACTAAAGACAATACAGTAGATGATGTAATCGAACTAAGTGATAAATTATATA

ATTTAAAAAATAAACCAGATAAATCTACAATCACAATACAAATAGGGAAACCCACTATTA

ATACTAAGAAAGCCTTTTATGATGATAATCGTCCAATAGAATATGGGGTGCACAGTAAAG

ATGAATAAAATTAATGATAGGGATTTAACAGAATTAAGTAGTTACTGGGTTTATCAAAAT

ATTGATATAAAAAAAGAATTTAAAGTTAATGGAAAAAGGTTTAAACAAGTAGACAGTTAT

AATGATGATAAGAATAGTAATTTGAATGGTGCTGCTGATATTAAAATATATGAGTTATTA

GATGATAAAAGTAAACCAACTGGTCAACAGACAATAATTTATCAAGGAACATCTAATGAG

GCAATTAATCCAAATAATCCATTAAAATCATCGGGGTTTGGAGATGATTGGCTCCAAAAT

GCTAAATTAATGAATAATGATAATGAAAGCACAGATTATTTAAAGCAAACAGATCAATTA

TCAAATCAATATAAAATAAAGTTAGAAGATGCAGATAGATTATCAAATAGTGATTTTTTA

AAAAAATATAGAATGGAATCAAGTAACTTCAAAAACAAAACCATTGTGGCGGATGGCGGT

AATTCGGAAGGCGGTGCAGGAGCAAAATATCAAGGAGCGAAACATCCGAATGAAAAGTT
```

TABLE 7-continued

```
GTTGCTACTGACTCAGCAATGATTCCTTATGCTGCTTGGCAGAAATTTGCTAGACCACGC
TTTGATAATATGATTAGTTTTAATAGTACCAACGATTTATTAACATGGTTACAAGATCCA
TTCATCAAAGATATGCCAGGAAAACGCGTTAACATTAATGATGGTGTGCCCAGGTTAGAT
ACTTTAATAGACAGCCATGTAGGTTATAAAAGGAAGTTAAATAGAAAAGATAACACATAC
GATACTGTACCACTAATCAAAATAAAGTCGGTAAAAGATACACAAATTAAAAATGGAAAA
AAAGTAAAAAGACTATTAACATAACATTAGATATGGATGGGCGAATTCCAATAAATGTT
TGGACAGGAGATTCGATTGCACGTTCTGGAAGAGGAACTTTAATTAAACTTAATTTAGAA
AATCTTGATGCGTTGAGTAAACTGATTACTGGTGAAACAAGTGGTATGTTAGCAGAATGC
GTAATCTTTTAAATGAAAGTTTTAACATCTCAGAAAATGAAAATAAAAATTTTGCAGAT
AGAAAGAAACAATTATCAGAAGGATTTAAGGATAAGATTAACTTATTTCAGTTAGAAGAA
ATGGAAAGAACTTTAATTAGTAAAATAAACTCACTTGAAGAAGTTGCAGATGAAACAATA
GAAAGTATTAGTGCTGTTAAACACTTATTACCTGATTTTGCATTGGATGCATTAAAAGAA
AGAATTAATGAGTTGTTTAAAGGTATAAAATCTTTTATAGAAAAAGTGTATGATAGTATA
GATAATGAAATTTTAGAAATTTTCAAAAATATAGATCACGACTTCAGAGATGGAGTATCT
GAAGAAATGAT
LOCUS 81
TGACGCTGCTTTTGTAAATACATATAATTTTTCCACTTCATGATTTAATTCGTTCGCATG
ATCTTTGTAATTTCTACCAAAAGCAATCACATTATTCGGAGGTGTTACTGGTGGTAAAAA
TTCAATGTCATTAAATGAAATTTTATAGTCTTCAGCTTTGCCGCTATCTTCTGCTGCTAC
AACTGCTTTACGTACTTGTTCTTGAAAATCTAAAGTATGATTTTGTTGTAAACCAGCTAA
CAATGTTTTAGGATGGAAATCTCCTTCTGCAAAGTCAGCAAATACTTGTGTTAAATCCCA
TACAGCATCTTCGCGTTTTACTTTAACGCCATATGAAGTTTTGTCATTATACTTGAATGA
TAAGAATTTCATTCATTCTCAACTCCTCGTCTTTATCTTAATTCACATTATAACTTTTTT
CGTTATCAAATAACAAATAAATAAGTAAGACAATTTTGAAAATGAGTTGTGTTCATTCTG
CTACAAGGACTTTGCACTTAATCGAAATTATTTTTATTCTTTTGAAAATCAAAATACTA
TAGTTGCAATGTACCAAATTTGAAGAAGTATAAATAACCTTTAACTTCTTTATTAAGAAT
CGTTTGAAGCGTATTTTGATAATATTTCATCTGTATCTTATATTTATTTTTTAATTGTGT
ACCAATTTCTTCATCTGTCATCCCACGGCGACGATTAAATGCATCGGTTTTATAGTCTAC
AAAATAATGCACACCATCTTTAACAAAGATTAAGTCAATCATACCTTGAATAATTGAGAC
GTCTTCGTCTCCTTGTGGCAATTGGTCAACTAATGCTTGGTTAACTACAAACGGTAATTC
ACGATAAACTTGCTCTGCTTCAGCAATAATCGAATATAACTCACTATTGATAAATGTCAT
TATTTCATCCATACGGATATCTTTTTTCGCATCTGCTTCGATAATATGTTTATCGATTAA
TCCATCGATATACTGATGTAACTCAACTTCAGATATGCGTTCTTTTTTGAATGGTAAATG
TTGCATCACTGTATGCATTAACGTACCAATTTCATTCGCTTTTCGTTTACCTTGTTCACT
TAGAAATTTAGGTCGTTCATACGTTGAAAAACCGATACGATATTGCCTTACTCGTTCGTA
ACTTGTGCCACTTTCTTCTGTTTCATATTGTCTTTTCAATTCAGAAACAGATTGTTTTGA
GGGCTTTTAGTATCATTTACATATGCATATCGATAATCAAGTTGGTGTTTAATTTGTGC
TTTAACATCTTCATTACCATTTTGCATAGTTTCTAATTGATTAACCGAACGATATTCATC
ATTATCTAAAATGGTTTCTGTAGACACATCTTCAAAGTACACAATTGAAATATTTACATT
CGGACGACTACTATCTTCAATTTGTGCTATATCTTTTTCAAATTTTAAATCATCTGGAAT
```

TABLE 7-continued

```
TGACGCAGATTGATGTTTAGATAAAATACTATAAATAAGATGGAACGGATTTGGTGAAGT

TAATCGTTCATTGACAGCAATGTGCTCACCAGAAATAGACAATTGCTCTAGTTCTAGTAA

TGATTTATCATTTTTCACTCTACCAATTAAATAAAGTTGTTCTTTCGCTCTTGTTAATGC

TACATAGACTAATCGCATTTCTTCTGACACAAGTTCTTTTTCGGCAACAGCTCTATATGC

AACCGAAGCTAAAGATGGAAATGCCATTTCTTTATCCACATCAAAATAATCCATTCCGAG

ACCAAATTGCTGATTTAAAATAACTGGTTGTTTCAAATCACGTTTATTAAAATCTTTTGA

CAATCCAGAATAAATGACAAATGGAAACTCTAGACCTTTACTACTATGAATTGTCATCAT

TCTAACGACATTATCGTTTGGACCAACTACATTTTCCTCACCAAAATCTTTGCCTCTTTC

AATCAATTCATCGATAAAACGAATAAATTGATATAAACCTCTAAAACTTGAATTCTCAAA

CTCGATAGCTTTATTAAATAAACCATAAAGATTTGCACGTCGTCCACGTCCACCAATAAG

TCCACTAAAGTATTGAATAACATAATGATC

LOCUS 83
GATCAACTTAATATAATG

AATTCGGCAACAGAAGAGCATCATCATAAAGATTATATTAAACTATATAATTTAGGTGGC

GGTGCTGCTAAAAAAATTGCAATAGAGGTTTTATTGGGGAAGGATAAAGTCATTCAGAAA

AAATACGTGCATATTTTACCTAGTAAAGAAGGGTACATGTTACCAATTAATAAAAATGTG

TACGAAGAATTAGAAAGAACGATTGAGAACAATGGTCATGAAGCTGATTTGAATGTACGT

ATGACTTATTATCATAATGTAAGTCGCAAACAACAGGAAGTTATATTAAAAGGTCAAATC

GACCGTTTTAATACTTATAATAATAAAGAAATTTATGATTTGCAGTTTATCTAAAAATTG

ATTTAAGAGGGTAGTTGTTTATTGCGAAAAATATCATTCAATTTTAATGAAATAATGGCG

TCATTACTATAAAATATTACTTTATGTTGTAATGCATTTTTCTATAAGATAGAACTAAAA

GGAGGGGCAAAGATGCAAATTAGACAAATACATCAACATGACTTTGCTCAAGTGGACCAG

TTAATTAGAACGGCATTTGAAAATAGTGAACATGGTTATGGTAATGAATCAGAGCTAGTA

GACCAAATTCGTCTAAGTGATACGTATGACAATACCTTAGAATTAGTAGCTGTTCTTCAA

AATGAAGTTGTAGGGCACGGTTTACTAAGTGAAGTTTATCTTGATAACGAGGCACAACGG

GAAATTGGATTAGTGTTAGCACCTGTATCTGTTGATATTCATCATCAAAATAAAGGTATT

GGGAAGCGATTGATTCAAGCATTAGAACGAGAAGCAATATTAAAAGGATATAATTTTATC

AGTGTATTAGGATGGCCGACGTATTATGCCAATCTAGGATATCAACGCGCAAGTATGTAC

GACATTTATCCACCATATGATGGTATACCAGACGAAGCGTTTTTAATTAAAGAATTAAAA

GTGAACAGTTTAGCGGGAAAAACAGGTACCATAAATTACACATCTGCTTTTGAAAAAATA

TGATTTCAAGCTAGGATTACATTAGGTAGAGTTCATATTAATAATAAAAAATGTTTGCAA

TCAAATCGTACGTTGTCGTTTGTAATTCTTAAAATAGCAATAAATAAAATGTTTGTTAGT

AAAGTATTATTGTGGATAATAAAATATCGATACAAATTAATTGCTATAATGCAATTTTAG

TGTATAATTCCATTAACAGAGATTAAATATATCTTTAAAGGGTATATAGTTAATATAAAA

TGACTTTTTAAAAAGAGGGAATAAAATGAATATGAAGAAAAAAGAAAAACACGCAATTCG

GAAAAAATCGATTGGCGTGGCTTCAGTGCTTGTAGGTACGTTAATCGGTTTTGGACTACT

CAGCAGTAAAGAAGCAGATGCAAGTGAAAATAGTGTTACGCAATCTGATAGCGCAAGTAA

CGAAAGCAAAAGTAATGATTCAAGTAGCGTTAGTGCTGCACCTAAAACAGACGACACAAA

CGTGAGTGATACTAAAACATCGTCAAACACTAATAATGGCGAAACGAGTGTGGCGCAAAA

TCCAGCACAACAGGAAACGACACAATCATCATCAACAAATGCAACTACGGAAGAAACGCC
```

TABLE 7-continued

```
GGTAACTGGTGAAGCTACTACTACGACAACGAATCAAGCTAATACACCGGCAACAACTCA

ATCAAGCAATACAAATGCGGAGGAATTAGTGAATCAAACAAGTAATGAAACGACTTCTAA

TGATACTAATACAGTATCATCTGTAAATTCACCTCAAAATTCTACAAATGCGGAAAATGT

TTCAACAACGCAAGATACTTCAACTGAAGCAACACCTTCAAACAATGAATCAGCTCCACA

GAGTACAGATGCAAGTAATAAAGATGTAGTTAATCAAGCGGTTAATACAAGTGCGCCTAG

AATGAGAGCATTTAGTTTAGCGGCAGTAGCTGCAGATGCACCGGCAGCTGGCACAGATAT

TACGAATCAGTTGACGAATGTGACAGTGGTATTGACTCTGGTACGACTGTGTATCCGCA

CCAAGCAGGTTATGTCAAACTGAATTATGGTTTTTCAGTGCCTAATTCTGCTGTTAAAGG

TGACACATTCAAAATAACTGTACCTAAACAATTAAACTTAAATGGTGTAACTTCAACTGC

TAAAGTGCCACCAATTATGGCTGGAGATCAAGTATTGGCAAATGGTGTAATCGATAGTGA

TGGTAATGTTATTTATACATTTACAGACTATGTAAATACTAAAGATGATGTAAAAGCAAC

TTTGACCATGCCCGCTTATATTGACCCTGAAAATGTTAAAAAGACAGGTAATGTGACATT

GGCTACTGGCATAGGTAGTACAACAGCAAACAAAACAGTATTAGTAGATTATGAAAAATA

TGGTAAGTTTTATAACTTATCTATTAAAGGTACAATTGACCAAATCGATAAAACAAATAA

TACGTATCGTCAGACAATTTATGTCAATCCAAGTGGAGATAACGTTATTGCGCCGGTTTT

AACAGGTAATTTAAAACCAAATACGGATAGTAATGCATTAATAGATCAGCAAAATACAAG

TATTAAAGTATATAAAGTAGATAATGCAGCTGATTTATCTGAAAGTTACTTTGTGAATCC

AGAAAACTTTGAGCATGTCACTAATAGTGTGAATATTACATTCCCAAATCCAAATCAATA

TAAAGTAGAGTTTAATACGCCTGATGATCAAATTACAACACCGTATATAGTAGTTGTTAA

TGGTCATATTGATC
```

LOCUS 84
```
GATCAGATTTATTAGACAGTATTCCAGATATACCCACACCAAAGCCAGA

AAAGACGTTAACACTTGGTAAAGGTAATGGATTGTTAAGTGGATTATTAAATGCTGATGG

TAATGTATCTTTGCCTAAAGCGGGGGAAACGATAAAAGAACATTGGTTGCCGATATCTGT

AATTGTTGGTGCAATGGGTGTACTAATGATTTGGTTATCACGACGCAATAAGTTGAAAAA

TAAAGCATAATTATATTGGCGGAAGAGCATCTATATATTTTTTTAAGTATATAAGACGTC

TTATTTCCCCTTAATTTATTGTGAAGTATATGCAAAATGCAATGAATAGATTGTCCATCA

TTTTAACGTTATAATGAATTTAACGACTTAGAACTACACAAGTAAAGGAGAATGAAGATG

TCTCGAAAAACGGCGCTATTAGTTTTGGATATCCAAGAAGGTATAGCGAGTAGTGTACCT

AGAATAAAAAATATTATTAAAGCGAATCAGAGAGCAATTGAAGCAGCAAGACAACATCGA

ATACCAGTCATTTTCATACGTTTAGTGTTAGATAAGCATTTTAATGATGTCTCCTCGAGT

AATAAAGTGTTTTCAACAATTAAAGCTCAAGGATATGCGATTACTGAAGCAGATGCATCT

ACACGAATACTTGAAGATTTAGCACCACTAGAAGATGAGCCGATTATTTCTAAGCGACGC

TTTAGCGCATTTACAGGTAGTTACTTGGAAGTTTATTTACGTGCAAATGATATTAATCAT

TTAGTATTAACGGGTGTCTCTACAAGTGGAGCTGTATTGAGCACGGCATTAGAAAGTGTA

GATAAAGACTATTATATTACTGTTTTAGAAGATGCTGTTGGTGATAGATCAGATGATAAA

CATGACTTTATTATTGAACAAATTTTATCACGCTCATGTGACATTGAATCCGTAGAGTCA

TGGAAAAGTAGTTTATAGTTAATATAACGTCAATTAAAGCTCGGCAGTAATGTTTGAGAA

TAAGTACATTTGCTCATATTTATAAAATGTGTGAGATGGCAATTGAAACGGATATGATGA

GGAACATTTGAACATAAAATAATATATTTATATAAAACGACCCGAGGCGTTCGAACTGAA
```

TABLE 7-continued

```
TGCCTCGGGTTTAATTGAATAAGAAATCGGACTTATGAACAGAAATATGTTTAAGTCCGA

ACTCCTTGTTTATACTTATAAATTTTACGGGTTTAATATAATACTTATTTACCTGTAATA

TATGATAATTCTTCAGCCGCAGCTGCGTTGATAGTTCTATGAGAAATGATACCTAATCCT

TTAACATTGGATTCTGAAATAACGATAGAACCATCACTGTTAACTTTTTCAACAAATGCT

ACATGACCGTAATGTTGATCTGCACCAAATTGTCCAGCCTCAAATACAACAGCAGCATGA

CGTTTTGGTGTATGACTTACTTGATAATCACGGTATTGAGCTCGATTATTCCAATTATGT

GCATCACCTAAATCACCTGAGATAGATGTACCAAATTGTTTCATACGGTTATATACGTAC

CAAGTACATTGGCCATGTGGATATGGCATACTATCAGATACCTCACGGAAAGGTTTGAAT

TCATCTGATGAATCATCATAATCCTTGATAGAACGTTCATATTTATCTAAATCTGGCATG

CGTTCATCGTCAAACTGAGTTAATTGATAGTGTTTAATAATACTGTTTAATTTCTTAGCA

TAGTTTGGATCTGTAGCATATGTTTTAGATAAGTGTGATGTTGCATCTTTATAAGAATCG

GCTTCCGATTTCCATGTTGGTTTATAAATTGTTCGATTGCCATCAATACCATTTTTAATA

AGGTCAGAGTAATCTTTTAGTGATTCTTTCGTGCTTGGATATTTTCGGAATCCAGCATTA

ATACTATACAATTGATTACCATCAGCTTCTAATGTGTTAAAAGGAACAGAATTCCCTTCA

AAAGCACCTTTGATACCGAATAAATTATGGTTTGGTGACTTAGCTAAAGCACTACGACCT

GAGTCAGATTCTAAGATTGCTTGGGCAATCATGACAGACGCATAAATATCGTTATCTTGA

CCAATGCGATGTGCATCTTTAGCAATTGATTTGACAAATTGACGTGTATCTTTTGAGTCA

ACAACGTTAAATTGTCCGCTATCATCATTGTTAGATATACTAGGATCTGTTTCGAATAAT

GATGTTGCACGTGTATCCTTTTGATTAACATCGTTATTGAATGATTGAGCAGGTTTAGAT

TTATGTTTCAATTCATCTTGTGTTGGTAACTGTGGATTCTTTGTATTAGATTTTTCATTT

TTGTCTTTTTAGATTGAGATGCATAATCTTTTTGTGTTTTCTTTGCATCTTCACTGTAT

TGATC

LOCUS 85 (F126)
TGGATCATTATATAATGCTGGATAATCATCGTTATATTCTAAGGTGCAAGTTACACCATA

CATATCCTCTAATCCTTTTGATAAACGTTTAATTTCTTTTTCAATTGTTGCTTTTGTAGC

ATCTGTTAATCCACGTACATCACCTTCAATTTCAACAACATCTTTAATGACATTGAATTG

ACCTTTACCGTCAAATGAACCGATTGTGACAACACCGGTTTCAAATGGACTTAGTCGTCT

AGATACAACTGTTTGTAACGCTGTGACGAAGTAGCTACCTGCAACAATGGCATCATTGGC

CATATGTGGTGATGAACCATGACCACCTTTACCTTGAACTTTCAATTTGAAGAATGCGCG

TCCTGTTTGAACATAACCAGGTCTGTAATACACTTTACCTGTTTTCATTGTGCTCATGAC

GTGTACACCTAATACATGATCAACACCGTCTAATACACCATTTTCAATCATTGTTTTAGC

ACCACCTGGTGGTACTTCTTCAGCTGGTTGATGTATCACAACGACTTTTCCTGTAAAACT

ATCTTTCATTTCAGCAAGCGTCTCTGCTAATACAAGCATGTATGCTGTATGTGCATCGTG

ACCACATGCGTGCATAACACCTTTATTTGTGATGCAAAAGATAATCCTGTATCTTCAGT

AATGGGTAATGCGTCAAAGTCTGCACGGATTGCTAATGTTTTACCAGGTTTCCCTGAATC

AATCGTTACTTTAATTCCACGTGGTCCGACATTCGTTTCTACTTCCACATCTTTACCTTT

GTAAAATTCAGCGATGTATTTCGCCGTTTCATCTTCATGAAAAGATAATTCTGGATGCTG

ATGTAAATAACGT

LOCUS 86
CCTGTGTAAGCGTGAATTGTAGTCATTAAACCTTCAACTAAACCAAAGTCATCGTTTAAA

ACTTTAGCAACTGGTGCTAATGAGTTTGTAGTACATGAAGCACCTGAAACAACTGTTTCA
```

TABLE 7-continued

```
GAACCGTCTAACTCTTGGTGGTTAGTGTTGAATACGATTGTTTTTAAGTCACCAGTAGCT
GGTGCTGAGATTAATACTTTTTTAGCGCCTGCTTCAATATGAGCTTGTGCTTTATCTTTA
TCAGTGTAGAAACCAGTACATTCTAATACTACATCGATATTTAAGTCTTTCCAAGGTAAT
TTGCTTGCATCTGGTTCACTGAATGATTTAACTTCTTTACCATTTACGCGGAAACCACCA
TCAACTACCTCTACTTCACCTGTGAAACGACCTTGCATAGTGTCATATTTTAATAAATGC
GCTAACATGTCGTCATCTGTTAAGTCGTTTACTGCTACAACTTCAAGACCTTCTACTTCT
TGAATTCTTCTGAATGCTAAACGACCAATTCTACCAAAACCATTAATTGCTACTTTTACT
GCCATTATAATGGCCTCCTTTAAAATGATATTTAAAAAGTATTAAACTTTTTATCTCTTA
TTCAAGTATTATCTTTGCTGCGGCTTCATCAGTGATTAACACTGTATTCTTGGGTGCAAT
CGTCAAGTATGCTTTAATTGCTTCACCTTTCGATTTGCCTCCTGCAACTGCAAAATAAA
GTCTTTTGATTCAAGGTCTTCTAATTGAAGTCCAATTGTTTTAACCTTATGGACAATTTG
ACCTTGTGTATCAAAATAATAACCAAATGCCTCTCCGACAGCTTGATGATGTTGAAGTTG
TTCAATGACCTTTTCAGGTGATTGACGTCGATGCGCCATCTTCAGCGCATCACCAATGCC
GTGTAATATAACGTTTGCTTGTTTAATTTTGTCTAAAGTGTTTATGACTGATGGCTCTAA
CAACAATGTATTATATGTTGTTTCACTGACATTATCAGGTACATACATCGTCGTATAATA
ACCGCCAGCTTGTTGTGCCATACTGGCTGCAATTGTGTTTGCCTGAAAGACAACATTTTC
GCCTAGTCCACCTCTGGCTGGTACGAAGAATACATTATATGGTAATAAATGAATTGCTTC
ACTAACACATGCCATCGTGGATCC
```

LOCUS 87
```
TGACGCTGCTTTTGTAAATACATATAATTTTTCCACTTCATGATTTAATTCGTTCGCATG
ATCTTTGTAATTTCTACCAAAAGCAATCACATTATTCGGAGGTGTTACTGGTGGTAAAAA
TTCAATGTCATTAAATGAAATTTTATAGTCTTCAGCTTTGCCGCTATCTTCTGCTGCTAC
AACTGCTTTACGTACTTGTTCTTGAAAATCTAAAGTATGATTTTGTTGTAAACCAGCTAA
CAATGTTTTAGGATGGAAATCTCCTTCTGCAAAGTCAGCAAATACTTGTGTTAAATCCCA
TACAGCATCTTCGCGTTTTACTTTAACGCCATATGAAGTTTTGTCATTATACTTGAATGA
TAAGAATTTCATTCATTCTCAACTCCTCGTCTTTATCTTAATTCACATTATAACTTTTTT
CGTTATCAAATAACAAATAAATAAGTAAGACAATTTTGAAAATGAGTTGTGTTCATTCTG
CTACAAGGACTTTGCACTTAATCGAAATTATTTTTTATTCTTTTGAAAATCAAAATACTA
TAGTTGCAATGTACCAAATTTGAAGAAGTATAAATAACCTTTAACTTCTTTATTAAGAAT
CGTTTGAAGCGTATTTTGATAATATTTCATCTGTATCTTATATTTATTTTTTAATTGTGT
ACCAATTTCTTCATCTGTCATCCCACGGCGACGATTAAATGCATCGGTTTTATAGTCTAC
AAAATAATGCACACCATCTTTAACAAAGATTAAGTCAATCATACCTTGAATAATTGAGAC
GTCTTCGTCTCCTTGTGGCAATTGGTCAACTAATGCTTGGTTAACTACAAACGGTAATTC
ACGATAAACTTGCTCTGCTTCAGCAATAATCGAATATAACTCACTATTGATAAATGTCAT
TATTTCATCCATACGGATATCTTTTTTCGCATCTGCTTCGATAATATGTTTATCGATTAA
TCCATCGATATACTGATGTAACTCAACTTCAGATATGCGTTCTTTTTTGAATGGTAAATG
TTGCATCACTGTATGCATTAACGTACCAATTTCATTCGCTTTTCGTTTACCTTGTTCACT
TAGAAATTTAGGTCGTTCATACGTTGAAAAACCGATACGATATTGCCTTACTCGTTCGTA
ACTTGTGCCACTTTCTTCTGTTTCATATTGTCTTTTCAATTCAGAAACAGATTGTTTTGA
GGGCTTTTTAGTATCATTTACATATGGATATCGATAATCAAGTTGGTGTTTAATTTGTGC
```

TABLE 7-continued

```
TTTAACATCTTCATTACCATTTTGCATAGTTTCTAATTGATTAACCGAACGATATTCATC

ATTATCTAAAATGGTTTCTGTAGACACATCTTCAAAGTACACAATTGAAATATTTACATT

CGGACGACTACTATCTTCAATTTGTGCTATATCTTTTTCAAATTTTAAATCATCTGGAAT

TGACGCAGATTGATGTTTAGATAAAATACTATAAATAAGATGGAACGGATTTGGTGAAGT

TAATCGTTCATTGACAGCAATGTGCTCACCAGAAATAGACAATTGCTCTAGTTCTAGTAA

TGATTTATCATTTTTCACTCTACCAATTAAATAAAGTTGTTCTTTCGCTCTTGTTAATGC

TACATAGACTAATCGCATTTCTTCTGACACAAGTTCTTTTTCGGCAACAGCTCTATATGC

AACCGAAGCTAAAGATGGAAATGCCATTTCTTTATCCACATCAAAATAATCCATTCCGAG

ACCAAATTGCTGATTTAAAATAACTGGTTGTTTCAAATCACGTTTATTAAAATCTTTTGA

CAATCCAGAATAAATGACAAATGGAAACTCTAGACCTTTACTACTATGAATTGTCATCAT

TCTAACGACATTATCGTTTGGACCAACTACATTTTCCTCACCAAAATCTTTGCCTCTTTC

AATCAATTCATCGATAAAACGAATAAATTGATATAAACCTCTAAAACTTGAATTCTCAAA

CTCGATAGCTTTATTAAATAAACCATAAAGATTTGCACGTCGTCCACGTCCACCAATAAG

TCCACTAAAGTATTGAATAACATAATGATC
```

LOCUS 88
```
GATAAAATTGTTTGTCTACATGTTCAGGTGCTGTCTCACGTGCATCAAACGCAGTTATAC

TGTCACCTTTATAAAATGCATTAAACCCTTGTTCTCTTAATATTTGAAATGTCTTACCTA

ATTCGGGTTGTACAATCCAATCACCTTCACGCCAATATTGATTTTCATGCGTAAATACTT

GTGCCGTTTCATGATACTTTGTCAATCGTGCGTGTTGCTGGCGCGAATATTTTTCAGTAG

CCCAATTGGCTGCATGACCTTCAATGGCTAGTTCAATTGCAGGATTAATTAAATCTTCCA

ATGACAATTTAGCATAACGCTTGTGAATATAATCAAACAGCTTTGGAATTGCTGGCACAG

CGACAGTTTTACCATGTGTAGTCATATCAAAAAATGATTTATATTCGCCTGAATCATCTA

GATAAAATTGTTTGTCTACATGTTCAGGTGCTGTCTCACGTGCATCAAACGCAGTTATAC

TGCCAGTACTTTGCTCATAATATAGCAAATACCCGCCACCACCAATACCTGATGCAAATG

GTTCTACCACATTCAATGCCAGTTGAATTGCAATCACTGCATCCATGGCGTTGCCACCTT

GATCTAATACATCCTTACCAATTTTAGCCGCAAGAGGATGTGATACGGAAATTAACCCTT

CTTTAGATGTTTTTGTCTGTTTGTCATTTAAGTTAATGACCATACTATATCCTCCTACTT

TCTGTTAAATATTTAAAACATTATTGATTAATGGCTTTTTCTACTTTTTCTAAATCTTGA

CGTTGCTCGTTACCAGTATCGACAAGTGGTGTAATCGGTGATGCAATTTTAAATTTATCG

CCACGATAAAACTTAATAAATTGATCCTGATCTATCGCATTAACTACTGCTTGTCTCAAG

TTTGGATGCGTCTTAAATATACCTTTTTTAATATTTAGCATTAAAAAGACTGACTTGCGT

CCATTTTTGCGAATAATGCTTAAATTTTTATCCGACTTAATTAAATCAAAATGTTTTTGA

TTCACATCTGCCAACATATCAATTGAATGATTTCTAAGTTCTGACAATGCATTATTCGGG

TCACCATTAAACTTCAATGTAATATTTTTAATTTTAGCTGGTCCATAACTACCTTTTTCT

GTTTCGTTGAATCCTGGATTACGTTGAAACGTTGCTTGATATGCATTTTTCTGTGTCATA

ATGTATGCGCCACTTGCATACAGCGCATTTTTCCCATCTGAATTTGCAGGAATTGTACTG

CTATCCCCATATCCTTTTGGATATTCTTGATTTACTTGATTAACAAATTTTTTAGATAAA

ATGCCTGCCGAAGAGTGTGTTAAGTAATTTACCTCTCGAGGCATCGATTGATCTGTCGTA

ATTTTAACAATTTGATAAATACCGTCTTTATTATTTACTTTTTGACCATCTGTCGTTAAC

GATTTGACGTTATAAGCTTTAATCAACTTATCATAGATTGATTTATCGTCCTTGTCTTTC
```

TABLE 7-continued

```
TCTTTACGCAACTGATCGATGTCCTCATCTTTTAATATCTTGATGTCATTTATATGTTTG
TGCATATTGTAAGTATTATTGTTAGGCACAGACTTTTTATCACGTGCTCTATCTAAAGAA
AACTTAACATCTTCAGCCGATACACGCTCTCCAGTATTACGTGCTTGTCCATTGACCACT
TTCGCAAAATAATCATCATCTCTTAACAAGAAATAAAATGCTTTATTGTCCTTATTCACA
GCATAATCATGACTTAACGAACCTTTCGTTGTTAAATGATCATTTTCATCTAATAATAAT
AACCTTGTGTACATATTCATATTAATTGAATATACTGACGGCGCAATTGAACGTATTGGA
TCCAATGTAGGAATTTCACCATCTTGTTGTGTCATCACAAGTGGCCGCGTATCTCGTTCT
CTACTATTGTTGTAATCAAATTGTTGCCATATTAATGCACGTGAATTTGGCAATCCAACA
CTATTTTTATCTAACACTTTATTGTCATATACTAAATTCTTTTTTGATCCATATAAAGGC
GCCATATACCCTTTATCAAATACAACTTCATCTTCAATTTGCTTATATGTTTGTTTAACA
TCTGCTTCATTTTGAGTAGAAGCTTTATTTAACAACTGGTCTACATGTTTATCTTTCAAT
AAACTATTTGATCCTGTAGAACTAAATAATGCCGTCATAGCATAGTTCGGGTCACCAAAC
ACTGTCATCCAGTCATCAATTTGGATATCATAATTGCCGGCTTGACGTTGTGTACGATAG
CTACCATAATCTGGTTGGATATTCATCTTCACGTTAAATCCTGCATTTTCCAATTGATCT
TTAACGATATTCATATCATTTTCATAACTTGCTTGTCCTAGGAAATGTATTGTTGGTCGC
TCGCCTTTCACTTCAACTTTCGATGACTTTTGAGCCACTTCTGATTTCGTAGGGACACCA
CAACCACTTAATACCAACGCTAAAACTATAATTGCGATACTAATGATTTTCTTCACATCT
ATCCCTACCTTTTTAATGAATTCTTGGATCTAGTGCATCACGCACTGCATCACCTATAAA
ATTAAATGCTAAAACGACGAACATAATACAAACACCAGGTACAATAGCTAAATTACTGTG
CGTTTCCAAGTAGTTACTACCGGTACGTAAAATGTTGCCCCATTCAGCTACATCAGGTGC
AACACCAAGTCCTAGGAAACTTAAACTACTTGTTGTTAATACAACCACACCTATATTTAA
TGAAAAACGTACAATCATAGGCGCAATCGCATTCGGTAAAATATAACGCCATATGATATT
CCAAGTGTTTTCACCAGTGATACGTGCTGCATCTACATATTCCATGCGTTTAATTTCTAA
AACACTGGCACGCATTGTCCGTGCAAATGATGGTATATTACCGATACTTAAAGCAATAAT
TAAATTTGGAATACTTGCTCCAAATGATGCAATAATTGCCACCGCTAACAATAATGATGG
AATTGCAAACACTACATCTAAAATTCGCATTATTAAATTATCAATATGATTAAAATAACC
TGCGATAGTGCCTAGTAACACACCAAAAATAACTGCAATAACTACTGAAATAATTGAAAT
TGAAAATGTCAGCTTCGTTCCTACAACTACGCGTGTAAATAAGTCTCTACCGAAATCATC
AGTACCAAACGGATAGGCTAGACTCGGTCCATGTAACAGTGCATTGAACTGATTTTTAGT
AGCCAATGTCGTATCAAATGTAAATTGTGACACAATTGATAATGTCAGCATGTAGACTAA
AATAAGTAACCCGATAATCGCAATACGATGTCTAGTAGTTTTTCGTATAAACGATTCCCA
CCCGTTATAACTATGTATTTGCGATGTACGTTGGTAACGTCTAATACTTACAAACATTAA
TAATGTAAATACGTTGCCTGTTAATGTCATCAACAATAACAACACTTCGACGATACGTCG
CCATAGGTCATGATGCTTCCATGTTTGTTCCGTTGTTAAAATAATAATTAAAATGATGGT
TAAAACGATTAGCAATGTTTCAGCAATATAGAACGTATCGGCCACATAACCTTTAAAAAG
ATTTAATGCACTCGTTAATATAACTAAAATATAAGTTGCTATGGCGTAACTTGCGAATAA
TTTTAAGGAAGCTATCTTTGAATTAAGTTGTGCCATATGCCTCACTTCCTTTCGTTGATT
TCACTACGTAATTTTGGATCGATTAAAGCATAAAATATATCAATAATTAAGTTTGCTAAA
GATATTACAATTGATATATATACGACCCCACCCATGACTGCTGGAATATCAGGTATTAGT
TGTTTTTGGACGATATAACGCCCGATACCATTAATGTTAAATACTTGTTCCGTCACTGCT
```

TABLE 7-continued

```
GAACCGCCTAGTAACTCTGCCACTAGAAGACCAACTAACGTTACAATTGGAATAATGGCA
TTTTTCAAAATATGTTTAATAACAACTTGTGTCGTCGATAATCCTTTTGCATAAGCAGTT
AAAACATAATCGCTGCGCATTACTTCAAGTACAGAAGACCTTGTCATACGCGTGATAGAA
GCAGCAATACTTGTTCCAATGACAAGTACAGGTAAAATCAACGATATTGGATGTTCTGGC
ATATAAGATGGTGGCAAAATATCCAATTTCAATGAGAACGCTAAAATGAATAATAGCCCT
TGCCAGAAACTTGGAATAGATAAACCAATTAATGCAATTATCATTAACGTGATATCAAGC
CAACTATTTCGCTTCATCGCACTGATAATACCAATTGGTATTGCAATAATTAATGCCACC
ATTAGCGCTAATACTGCGACAATTATTGTAATTGGAATTCTTTCGCCAACTGCTTTAGTC
ACAACCTCATTCCCTTTGTAAGTCGTACCTAAGTCAAAGGTAAAAACACCCTTGATGGTA
TCCCACAATTGAATAAAATAAGGTTCGTTAAGATGATGTAATACATTGAATTGATGTATC
TGTGCCTTTGTTGCATTTTGTCCCAGTATGCTATAAGCCGCATCAAGCGGTGAAAAATAC
AGAATGGTAAACACACTGACAATAACACCAATGATGACAATCACAGCCATGACAATTCGT
TCAAAAATATATCTAACTAATGGCTGTAAATAAAAAGTCAATAAGATGAACATCGGCAAG
GCCAATATCA
LOCUS 89
ACGGATTGCTGTATTGAGTTGGTTATCATTATGTATATGTATCGCTTTAGCGCTCATATT
ATATGCATTACCATATCTCATTCTCGGTAGCAATAATTGGTCTTTTGTACTGACTTGGCT
ACCAATAGAAATTAAATTAGCACTAATCACAACATTAATTGCATTATTCAGTACATTAAT
TGTAATTCTGTTATTCCTTCATACAAAGATAACGAAGACATAATAAAAAGACTTGTTCG
AGCCGTGCGTTTGATAATATATCATCCACGATTCGACCAAGTCTTTATTCTTTGTATATT
AAACGGATAAATTATTATTTAATTGGATTCATGCCATCTTTCCAAGTTTGATAAATCAGA
GTACCACCTTGCGCTTTAAACTTCTCATTGCTTACGCCACGTTCAAATGGTTGCGCAGGT
TGAATATCAATATTTGGTTCAACACCAAGTTGTTCTTTATACCATTCTGCAAATTCAGAA
CCTTTAACAGGTGCATCATCTGCTACATTATAGATACCATTTTCAAAATGAATAGCTTGA
ATAGATGTTTCAACTGCATCATCAAGATGCACAAATGATGTTACGCCATCTGAAAGTGTC
ACTTGACCATCCATAAATTGATTATAAATCATGCCATCTTTTCCGTACCAAGTACCTGGG
CCATATAACCAGCCAAAACGTAAAACAACGTATTCATCCATACGAGCCGTTTCTTCTTCT
AAACCAACCACACCATCAACCGTTACTTTTCTATCGCCAGTTGAGTTAAAATCAAGTGAA
GTTTCCTCATTTGCTAATCCTTCGCCAGGTTCATACATAAAGGCAATACTTTGGGCAATT
ACTTTCTTAACGTCATGCTTTTTCGCCGCATCAATTAGGTTTTTAGAACCTTCAATACGT
ACTTTCGTATTTGCTGCCATATCAACATTTTTTAAATCCGTAATTTGATTGATAATGATT
TCTGGTTTAAAATCTGCTAACGCTTGATCAATAGTATCAGCTTTTAATATATCACCAATA
TATGCTTTTACATTAACAGCAGCTAGCTTTTGTTGACCATTCTCAGATGTAGTAAAACCA
GCAACCTCATGCCCCTCTTCTTTTAGTCTTTGAACTAATTTAATGCCAATAAGGCCCGTT
GCACCAGTTACAAAAATTTTACTCATTATAAACACCTTTTCTCTATTTGTCTTTTTAATA
TAATTACTTGCTTGATGAGTTTACAAAATTCACGTGAGACTTCCAAATGATTTGCCTCAA
AATTTTTCAAAGTGTCGTCGTAAAAACTGTCTAGTAAATACTAATAGTATGTCGTAGACC
TATGACAAATCTGAATTATGACGAAGATCAATCAAGAAAAACAGCACCAAGATCATTTCA
ATTTGAAAGTACCTTACTGCTGTTCTTTATTTATTACATTTCAATGTTAA
LOCUS 92 F102
CCTGTGTAAGCGTGAATTGTAGTCATTAAACCTTCAACTAAACCAAAGTCATCGTTTAAA
```

TABLE 7-continued

```
ACTTTAGCAACTGGTGCTAATGAGTTTGTAGTACATGAAGCACCTGAAACAACTGTTTCA

GAACCGTCTAACTCTTGGTGGTTAGTGTTGAATACGATTGTTTTAAGTCACCAGTAGCT

GGTGCTGAGATTAATACTTTTTTAGCGCCTGCTTCAATATGAGCTTGTGCTTTATCTTTA

TCAGTGTAGAAACCAGTACATTCTAATACTACATCGATATTTAAGTCTTTCCAAGGTAAT

TTGCTTGCATCTGGTTCACTGAATGATTTAACTTCTTTACCATTTACGCGGAAACCACCA

TCAACTACCTCTACTTCACCTGTGAAACGACCTTGCATAGTGTCATATTTTAATAAATGC

GCTAACATGTCGTCATCTGTTAAGTCGTTTACTGCTACAACTTCAAGACCTTCTACTTCT

TGAATTCTTCTGAATGCTAAACGACCAATTCTACCAAAACCATTAATTGCTACTTTTACT

GCCATTATAATGGCCTCCTTTAAAATGATATTTAAAAAGTATTAAACTTTTTATCTCTTA

TTCAAGTATTATCTTTGCTGCGGCTTCATCAGTGATTAACACTGTATTCTTGGGTGCAAT

CGTCAAGTATGCTTTAATTGCTTCACCTTTCGATTTGCCTCCTGCAACTGCAAAAATAAA

GTCTTTTGATTCAAGGTCTTCTAATTGAAGTCCAATTGTTTTAACCTTATGGACAATTTG

ACCTTGTGTATCAAAATAATAACCAAATGCCTCTCCGACAGCTTGATGATGTTGAAGTTG

TTCAATGACCTTTTCAGGTGATTGACGTCGATGCGCCATCTTCAGCGCATCACCAATGCC

GTGTAATATAACGTTTGCTTGTTTAATTTTGTCTAAAGTGTTTATGACTGATGGCTCTAA

CAACAATGTATTATATGTTGTTTCACTGACATTATCAGGTACATACATCGTCGTATAATA

ACCGCCAGCTTGTTGTGCCATACTGGCTGCAATTGTGTTTGCCTGAAAGACAACATTTTC

GCCTAGTCCACCTCTGGCTGGTACGAAGAATACATTATATGGTAATAAATGAATTGCTTC

ACTAACACATGCCATCGTGGATCC

LOCUS 93 H128
GGCTATCTATCAAAATAAAGATGGTCATTTAAAGCGTACACTTCGGGTGCGTGATTTCTT

AGCTTTAGGTGTAGGAACAATTGTATCGACATCTATCTTTACGCTACCTGGCATTGTTGC

TGCAGAACATGCAGGACCGGCCGTTGCGTTATCATTCTTACTCGCTGCTATTGTTGCTGG

TTTAGTTGCATTTACTTATGCAGAAATGGCTGCCGCTATGCCATTTGCAGGTTCAGCCTA

TTCTTGGGTCAATGTATTATTTGGTGAATTTTTTGGATGGGTTGCCGGTTGGGCTCTATT

AGCTGAATATTTTATCGCCGTAGCCTTTGTTGCATCAGGATTCTCAGCGAATTTACGCGG

ACTTGTGAAACCAATTGGCATCGAATTACCTGCAGCATTATCAAATCCATTTGGTACAAA

TGGCGGTTTTATCGATATTATTGCTGCTATCGTTATTTTATTAACTGCATTATTACTATC

ACGTGGTATGTCGGAAGCAGCTCGTATGGAAAATATTTTAGTTATTTTAAAAGTATTAGC

TATTATTTTATTTGTCATCGTAGGTTTAACAGCAATAAATGTTAGTAACTATGTGCCATT

TATTCCAGAACACAAAGTAACTGCTACAGGTGACTTTGGTGGATGGCAAGGCATATATGC

TGGTGTTTCAATGATTTTCTTAGCGTATATCGGTTTCGATTCTATCGCAGCAAACTCAGC

AGAAGCACTTGATCCTCAAAAGACAATGCCTAGAGGTATTCTTGGTTCTTTAAGCGTTGC

TATCGTATTATTTATTGCTGTAGCACTTGTGTTAGTTGGTATGTTCCATTACTCACAATA

CGCAAACAATGCTGAACCTGTTGGTTGGGCTTTACGTCAAAGTGGTCATGGTGTTGTAGC

AGCTATTGTTCAAGCTATCTCTGTTATCGGTATGTTTACAGCATTAATTGGTATGATGTT

AGCAGGCTCACGTTTACTTTATTCATTTGGACGTGACGGCT

LOCUS 94 HA2
GATCAAAATTAGGCTTGTTTGCTAATTTTACCGCATTACCATGTTCGCTTTCGCGGTTCG

CAAAACCATCTAAAATAATTAACGCAGTTGGTTTCTTAGCCATGATTATTTTGCACCTTC

TAACAATTGTACGAAATCTTCAACTTTAAGTGATGCGCCACCTACTAATGCCCCATCAAT
```

TABLE 7-continued

```
ATCAGTTTGTGCCATGTATTCTTTAATGTTGTTAGGTTTAACACTACCACCATATTGAAT

ACGAGTTGCTTCTGATACTTCTTTGCTTGATAAGTCAGCAATAGTTTGACGTACAAATGC

ACACATTTCATTTGCATCTTCAGATGTTGATGATTTACCAGTTCCGATTGCCCAGATTGG

TTCATAAGCAATTACAACTGATTTAAGTTGATC

LOCUS 95 HA5
GATCTTAAACTTTATCTTTAGCTTTTTAGCTTCAATGTTCTTCTGCGTCATTTTTGATGC

ACCTAGAAAATTATATCTATCATGTGGTTTCGTTGGTACGTGTGGATGGATGGTTTACAC

CTTATTCTTCAACGGCTTTAATGTGCACACTATATACTCTAGTTTCTTTGGTAGTTTAGC

ATTAGGCTTGTTAAGTCATTATATGGCTCGTAAACAAAAAGAACCTGCCATCATTTTTAT

GGTAACGGGTATCATTCCATTAGTACCTGGTGGCTTAGCATACGATGCTACAAAAAATTT

AGTCTTATTAAATTTCAGTACAGCAATCAATACCATGCTAGAGGTTACACTTATTGCAGG

CGCCATCGCATTAGGTTTATTATTCGCCGACCAAATTTCCAAATTAATTGTTTCTGGGTT

CGTGAAATCTTTTAAACGATTATAAATATTTGTTAGAAATGGCTCAGCCCTAACTCTTAG

CAATTATATATAAGGTTCAGCTGCCTCGTCTTAAATGTCAATTTATAATACAAAAAATCG

CACGATACGCCTCCGAATGAAGAAGGTTTATTGTGCGATTCTTTTATTATTTAGTTTTTT

CTTTTTCAGGTTCTTCAATCATATCATCAACTTCATTTTCACTTCTATTTAAAATCAAGC

GACTTAATTCATCATTATCCATATTTTTCAATTTAGGATATCGAATCACAAAGAATATTA

AACCGATGATTAACCATCCAAGTAATGCAATATAAGACGGTGCAGTCAGTGCTGCAGGAG

AACCTGGCACTAATAACAACGCTAAGAAAATGAATGATACAAATGAGCCGATAATAGCAA

ACGTTTTGTAAACCGGTGCATACGTATTACTTTGTTTGTTATAACTGAATAATTTCGCTG

CAGACAAACATGTAATAAAGTAGGCAATGGATACACCAGTAGATGACATATCTACAATCC

AAGTCAATGCAGTTCTTCCTAGCCAAGGTGCAATTAACGACACTCCTACTAGGAATATGA

TTGCGACATATGGTGTTTTGTATTTACTATGTAATTTACTAAACATTGTTGGCATAATAC

CTGAACGTCCCATAGAAAATAACAAGCGACTTGAACTCATCAAGAATCCATTTAAACCAG

TAAATATACCCATCATAATTGCAATTGCTAATACACCTAATCCAATATAACCAAATGCTG

TTTGTGTAACAGCACCTGTTAACCACAACTGCCCATTTAAACTTTGATGACTTGTTGATA

ACCAACCAGTGTATAAAATCATGACAACATAAGTTAATGATGCTGCTAATAAACTGTACA

CGATAAGCTTAAATGTCTTGTTTGGTGCAAAGTTAAACTCTTCTGCTGTTTGTGGAATAT

TATCAAATCCAACATATGCCCATGGTGCCACGGATACAATAACCACAATAGACACTAACC

ATCCTTTGCTAGGTTCAGCTAACGGTTGTAAATTTTCAAGTGCAAAATTATTACCAAAGA

ATGAACCAAAGAACATCAATAATACGACGATTACCATCGCCACACAGAAATAATATTGTA

ATGATCCAGATACACTTGCGCCACGAATCGTTACTAGCATGAATACAATGAGTAATACGG

TCGCAATAATGATTTCCGTAATATAAACGTCCCAGCCCGCAATGGTGTATAGTTTCCCAT

TATTTAAGACATCTGGCAATAAGAATTTAACTAGTAAACTGAATGCGGTCGCATTTAAAG

CAACGACACAGACATAACCAAAAGTTAAAAACCATGATGAGAAGAAACTCACATATCTGC

CGAAACTTAAGAAACTAAAGGCAAACGCGCCCCCTGATACTGGAAATCTCTCTACTAATG

CGCCATAACTAACCGCAATTAATATCATTAATAATGCACCAATAACTATACCAATTGATG

CTGCAATCGGACCTGACTGCTTAATCCAGTGTCCTGGTAAGATGAATGCGCCCCATCCGA

TACATGAACCATATGCAATCGCCCATACAAACTTTTCAGATAGGTTTTGTTTTAAATCGC

CTCTATCTATTTGCTTATTCTTTTTTTTCCATAAATAAAAACTCACCTCGAAGGTATTCTA
```

TABLE 7-continued

```
TACCCAAAAGATGAGTTTGTAACTCTTTTTCTTGATTATTTTTATTAAAAATTTAATGTT
TAGTTACATAGGTAATCTAAAGTTTTAAAATTTAACCAGCAAATTTGAATGTCGCAATGA
TTAACATTATCCATCCAATGATGAACAATACGCCACCAATTGGCGTAATCGCACCTAAAA
CTTTAATTTGAGTTAATACTAAAATATATAATGATCCACTAAAGAAAATAATACCAGCAA
ATATTAACCAGCCAGCCCAGTTAACATTGATTGAAGTTGTACCACTAATTACACCTATAA
TTAATAATGCTAAGCCATGGTACATTTGATACGTCGTTGCTTTTTCCCATACTGATAAAT
AGTGATC
LOCUS 96
GATCCAACATTACGACGCGTGATGAACGAAATAGATAAAAAGCCAGAGTTAAGAGAGCGA
TTTATTACATCAGATGATGCTTGGGATATGATGACATCTAAGACAACCGTAGTGATTGTT
GATACGCATAAACCGGAACTGGTTTTAGATGAAAATGTCTTAAATAAAGCAAACCGTAAA
GTTGTTATCGATC
LOCUS 97 (HA12)
GATCGGAATTCCGTTTGCTGCGGGCTTGATTAATTTTGTAGTATTAACCGCTGCTGCTTC
ATCATGTAACAGTGGTATATTCTCAAATAGCCGTATGCTTTTCGGTTTATCAAGTCAACA
ACAAGCACCTCCGAACTTTTCTAAGACGAATAAATATGGCGTTCCACATGTTGCAATCTT
TGCTTCATCAGCATTATTACTTGTGGCAGCATTACTAAACTATATTTTCCCAGATGCGAC
AAAAGTATTTACGTATGTGACTACCATCTCTACAGTGTTATTTTAGTTGTATGGGGTCT
GATTATCATTGCATATATCAATTATAGTCGTAAAAACCCAGATCTACATAAAAATGCTAC
GTACAAACTATTAGGTGGCAAATATATGGGCTACTTAATATTTGTATTCTTCATTTTTGT
GTTCGGGTTATTATTTATTAATGTTGATACAAGACGTGCAATTTATTTTATTCCGATTTG
GTTTATACTTTTAGCATTTATGTACTTAAGATATAAACGTATCGCTGCTAAATCAAATAA
ATAACAACAAGTTTTAGGGCTTGGGACATTAAGTTCTTAGGCAATGTAAAAAAGCTGATT
TCTATTAATTATTTGATAGAAATCAGCTTTTTGATATGTATTTTATAATGTACAGCTCG
TTGAGCTGCTATTTTCCTTATATTAAGTGCCATCAATACAAAACCTAGCTCTCGTTTAAC
TTTATTTATTCCTCGAACTGACATTCGAGTGAAACCCAAAATAGCCTTCATAAATCCAAA
AGCAGGCTCTACATCAATTTTTCTTTGACTATAGATGTTTTTCGTTTCTGGTTCAGAAAG
CTTTTGATTAATTTGGACTTTAAAGTATTCCCAATTATAATTCTTCATGATTTTCTTATT
GGATTTCGAATTTGGTTTCATGCATTGATGTCTCAAAGAACATGATGAACAGTCATCACA
TTCATATAGTTTGAAGTCTCGTTTAAAACCATATCTATCATTACGGTATGCATATCTTTT
AAAACCTATTCTTTTGTTATTAGGACATATAAATTCATTATTAAGTTCGTCATATTTCCA
ATTTTGAGTGTTGAAAATGCCACTTTTAAACTTTCTAGTTTTATCTTTAATAAACATGCC
ATACGTAATAAGTGGCGTTTTATTAAAATCATCTATAATAGCCATATAGTTTTGCTCACT
ACCATAACCTGCATCAGCTACAATATACTCTGGTAAATAACCGAAGGTATTTTGAATCAT
TGTTAAAAATGGGATTAATGTTCTAGTATCTGTTGGGTTTTGAAATAGGTCATAGGATAA
AACAAATTGAGAATTTGTCGCTATTTGTAAATTGTATCCTGGCTTAAGTTGGCCATTTTT
CATATGGTCTTCCTTCATTCTCATAAAAGTTGCATCATGATCAGATCAGTTTTAGAAAAA
CTATTTCTATCTTTAAGAATCGATTTTGTTCTTCATATTTATTTTTCTTTCGGAATAA
TCATCAAATTTCTTTTTGAACTTCTTAATCTCAGTTATTTTTTACGGGTCTGTTTTCTA
ATTTGAGCACAATCTTCGTTCTCAATAGAATGATTTAAATCTTCGATTTCTTTATCTAAA
TGACTACCAATTAAATCTATTTCTTCTATTGTTAAATCGCTATCTCCATCTTCTTTTATC
```

TABLE 7-continued

```
TCTGGTATTATTTTTTCTTCAACTAAGTCACGATATAATGTTTTTGAATTTTCGTTCAAT
TTCGATTCGTGATTTTGAATACTTTTCTTCCACACAAATGTATATCTATTGGCATTAGCT
TCTACTTTTGTACCATCAATAAAAATTGAATTATTATCAATAAGATTTTGCTTTAAACAT
TGACTATGGAACTGAATAAATAAAGATTCAATTAACGCATCAGTATTAGGATTCACTCTA
AAACGATTAATAGTTTTATAAGAAGGTGTTTGATCTTGAGCTAACCACATCATTCGAATA
CTGTCATGAAGTAATTTTTCTATTCTACGACCAGAAAATACAGATTGAGTATATGCATAT
AAGATGATTTTTAACATCATTTTTGGATGATAGGATGTTGCGCCACGATGATGTCTGAAT
TCATCGAATTCGCTATCAGGTATCGTTTCAACAATTTCATTAACATATCGCGAAATATCA
TTTTGAGGAATTCTAACAGAGGTTTCTATTGGTAGTGTAAGTTGGGTCATGTTATAAATT
TTATACATAAGGCACCTCGTTAATTTAGTTTAGTGGTATTTATTAAATTATACGAAGGGA
CCCAACACAGAAAATTCATTTTATTGAATTTTACATTTATGTGCAAGTTGGGCAAAGTGT
TTTATTTTTTAAAGTATGTAAAAGTAAAATTACATGTTAATACGTAGTATTAATGGCGA
GACTCCTGAGGGAGCAGTGCCAGTCGAAGACCGAGGCTGAGACGGCACCCTAGGAAAGCG
AAGCCATTCAATACGAAGTATTGTATAAATAGAGAACAGCAGTAAGATATTTTCTAATTG
AAAATTATCTTACTGCTGTTTTTTTAGGGATTTATGTCCCATCCTGTTTTATATGCAACT
TATAATATTAAATTGCGTACTTGGCTCAAAACTTTTACTTTCTCATCTATTTAATAATGT
ATCATTTCAGAAATACATCCATACTTCTATTTTATAATAAATTTCCAAAGTAATATGAGT
GAAAGTTTGAAGGTGATAATGTACATGTATAAAAGATATAAACATTTATATAGATTGCCA
TTCATACACTATCATTATCAAATAACCTATTAATTACGTCATAAAATACCAGATGAACCA
AAAAACGCCTTTCCATTGTTGATAAATGGAAAGACGTTTTTTTATAAATTATAGTACGTT
TGCATATCCTTCAAAGATTTTACCTTGAGCAGCATCAATCGTAACTAACATGTTATTGCT
TATGTTTTTAACAGCTTTTTCTACACCTACAACTGTTGGAATACCTTTTTCTAAACCAAC
AATTGCACTTGGTGATGTAATACCATTTTCTTCTGTAATTAAGCCTAAAGCTTTTTCTAC
ATAAGGTACAAACGTTTCATCGATTGAGTTAGTAACGATAACTTTGTCAGATAAATCTTT
ACCTTCTAAATCTTTAACAGTTTCAGCAACTAACGTAGTACCAACAACTGATC
LOCUS 98 GE2
GATCCACATTGGGCATAATCACAGCTAATTTGTGTTCATTCGCATACCTTTCTATGCTTG
TATATCTCATATATGTCGTTTCATCACTTGATAATCCATGTAACAACATTAAAGTTTTTA
ATGGTTTAACAGTTGTATCGCTATTAAAGAAGCTTTGATCTTCCGGTAAAATGACTGTCA
AATTTTGATGCATACCAATTGTTGGTGAATGATAGTTTAATGAAATATAAGCCATACGTC
ATGACCCCTTTCTAATTCTACTTTATCAACATTTTACGCTTAATCAATTCACTTTAAAAT
CATTTTCAACAAAAAAACCGAATACAAATGTATTCGGCCTAAAAAGTATTTACGCTTTT
TCTTTATGATCTTGCTTGCGTTTTCTAAACAATAGTAATGATCCTAATAATGCCATCATT
GCACCAAATAAAGTTGCATTTGTGTTTTCGCTCTTATCTCCTGTTTCTGGTAAAGCATCA
GTTTTGTGTTGTTTTCATACCTTATTAGAATGGTTTACTTCACCTTTAGGATTTGATGGT
GCTTTCTGTTCATTATTTGGTGGTGTAACTCTTGAATCGGAGTCACTATCTGAGTCTGAG
TCGCTATCTGAATCCGAGTCGCTATCCGAGTCTGAGTCGCTATCTGAGTCTGAATCGCTG
TCTGAGTCTGAGTCGCTATCCGAGTCTGAGTCGCTGTCTGAATCTGAATCACTGTCTGAA
TCCGAATCGCTATCTGAATCTGAATCGCTATCCGAGTCTGAGTCGCTGTCTGAATCTGAA
TCGCTGTCTGAGTCCGAATCGCTATCTGAATCTGAGTCGCTGTCTGAGTCTGAATCGCTA
```

TABLE 7-continued

```
TCTGAATCTGAGTCGCTATCTGAGTCTGAGTCGCTGTCTGAGTCTGAGTCGCTGTCTGAG

TCTGAATCGCTATCTGAATCTGAGTCGCTGTCTGAGTCTGAGTCGCTATCTGAGTCTGAG

TCGCTGTCTGAATCTGAGTCGCTGTCTGAATCTGAATCGCTGTCTGAGTCTGAATCGCTA

TCTGAGTCTGAATCGCTATCTGAGTCTGAATCACTGTCTGAGTCCGAGTCACTGTCTGAA

TCTGACTCACTATCTGATTCTGAGTCGCTATCTGATTCTGAGTCGCTGTCTGAATCTGAA

TCACTGTCTGAATCCGAATCGCTATCTGATTCTGAGTCGCTATCTGAACCTGAGTCGCTG

TCTGAGCCTGAGTCACTGTCTGAATCCGAATCCGGATCCGGGTCTGGGCTTGGTTCCGGT

TCTGGGTCTGGACTTGGTTCTGGATCTGGCGTTGGTTCTGGTTCTGGGTCTGGACTTGGT

TCTGGGTCAACCGGCGGCCCTGGAGTTGGGTCTTTCGGATTTACTGCTGAATCACCATCA

GCACTTCCACCACCATAACGTACAACATTCTCATTATTCCAACCGAAAATACTGTAGTCT

CTATTTGTTACAGGATCAACATTTTCTTGAATAACCTGAGTTTTTAAGTTCTTACCTGTA

TTGTCGTAATGCCCTTCTACTAATACTACATATGTTTTAGTAATATCACCAAATTTAATA

CTAGCTACATTTGGATGCTCATAATAGATTCTATTTTTAAATTGGTCTGTTACTTCTTTA

AGGTTAGAGTCATTTGGATCTGCATAGTAGCTATCTGATAATTTAGATGTATCATTCACT

TCAAAAATTCTCAGTTTTGTATCTGTAGCACTTACTTTACCGCTACTTTCTTCGATTTTA

TCTTGGTAGCCTTTAATATACACCCACGTATTACCTAAAACTCGTTGCTTAGGGTTAACA

AATACTGTTTGCTTGTATGTGTTTTGACCTGAAGCTGTATCTACACCAATAATTTGAGAA

GAAATGTTCGCGCCATTTGGTTTATCAATTCCTGCAATTGGCGAACTATAGTTATAAGTA

ATTTTATTATTAAACATTTCATCCGCAATATTAATATTCGCATCATATGTTCCTGATTTA

GGTGCCTTTGCTCGGTCTGTAAATAAAGGTAATGAAAATTGTCCGTTAATATTTTCTTTA

TTATTTACATAATCTGTAAAGACAAATGTATACGTCTTAGTCAAGATATCATATGTTGCT

TTAGCTACAACATCGCCATTCGTACTTTTAATGTCTGCAATTGGCATCGTATTATTTGAA

TTAGAATAATCCACGTCTCCATTACCAGTTAAACTATCTGGTAACTTCGCTGTAAAATAA

TCCCCTGATTTCACTTTATCTGTCACTGTAAAATTTGCCGCCATAAATGTGTTACCACTT

TGATTAGGGTCAAATGTAGTCTTTTCTAACTTGAAATTACTTGCCGTAACTTTATCATTT

ACATTTGTACCTTTAGCATCAGCAGCATTTACTACCGGTTCAGCAACAGCTAAACTACGT

ACAGCTCTCGTTCTAACACTTGGTTTACTAGTTCCTTGCGCATTGGAAATCGTTTGTGGT

GATGATTGTGGTAAATCTAATGTTTGAGAATTTTTAAGCTCACTGTTTGTTGCTATGCTA

TTAGCATCATTCGTTGTTTTATTATCTACTTGAGAATTTGCTTCTTGAGGAACAGTTTGA

TC
```

LOCUS 99 GE3
```
TTAATGATTTCTAACAATCTTAATGTTGCTACGACGTTTATTTCTTGAGATAAGATAGGT

TTCTCAACCGACTCAGCAACACTAACTAATGCTGCTAAATGAATAACATAATCAAATTGA

TATGTCTTCATGATTTGTTCAACTGCATCATATTCACGAATATCTAATTCAAACACATGA

TCGTCAGCCAAACTTTTAATATTTTCTCGTTTACCTGTTCTATAGTTATCTAGAACATAA

ACATCATAATCTTGTTGTAAATCATCTACTAAATGCGACCCAATAAAACCAGCCCCACCA

GTTATCAAAACTCTTTCCAAATCTTCCACCTCATTTATACATTAAAAATATATCATAAAA

ACATAAAGTATTGTAAGCTTTTTATCGATATTTTTTATTTATAAAAATAAAATGAGATAA

CTTTGTGAATTTTTATTGAGATAAATTAGATAGTGGTGTTTTTGTGATGTTTTATAATAT

CTTGGGTGTGTTAATACTAATAATGCTTTCAACTGATGCATTAGACTGTGACATCATAAC
```

TABLE 7-continued

```
TCACTTAAGAACTTCGCTTATTAATTTTCTACCAATACACTCCCTTCTAAGTGCACTAAA
AAATCCTTACTGCTAAGTGATTAAACTTAACAATAAGGATTTATTTATCATTAGTGGATG
ATTATTAACGGAATCTCATACCACCATCTAGATAATTGTTTGTCCAGTAATGTAATTCAG
AGTCTTTACCAGCTAAGAAGCTCACTACATTTGAAACATCTTCTGGTTGAGAAACTCTGC
CCAAAGCAATCTGACTTGTAAATTGTTCCCAACCCCATGCTTCAGGTTTACCTGCTTCTT
CGCCAAATTGCGCGGCAGTTTGTCTTACTGCGTTAAATACATCATCACGGTTTGATACAT
CATTCACAGTAATACCTTCAGACGCTAAATCTTGTGCGGCTACTTGTGTTAAACCTCGCA
CTGCGAATTTTGTACTGCAATATAAAGACAAGCCTGGGTTACCCTCAACGCCTGCTTGAG
ATGTTGCATTGATAATTTTACCGCCATGATTGAATTTTTTAAATTGTTCATGTGCGGCTT
GAATACCCCATAGCACACCTGCAACGTTCACGCCATATACTGTTTTAAACTGTTCTTCAG
TAATTGTATCGATTGGTGTTGTTGGTCCAAGGCCGGCATTGTTAACCATGACATGGAAAT
CGCCAAATTGCGCGGCAGTTTGTCTTACTGCGTTAAATACATCATCACGGTTTGATACAT
CTGCTTTGATAGCAATAGCTTTTGTACCATCACTTGATAATTTAAGTGCAGCTGCTTTTG
CCCCTTCTTCATTGAAATCAACAACTGCTACTTTGAAACCATCTTCCACTAAACGTTCTG
CAATTTTAAAACCAATCCCTTGTGCTCCGCCAGTTACTAATGCTACTTTGTTGTTTGTCA
TAAAGATC
LOCUS 100 GF5
GATCTACTTCTACAACTTTAGGCATGTCTGCTAAGTGAACACTTTCTTCTTTAACATGTG
GTGTATGAGACCAAACTTCTTCAGCTGTATGCACTAkGATTGGTGCTAACAACTTCGTCA
TATCAACTAAAATTTGATATAACACTGTTTGCATACTACGACGGATATGAGAATCACGTT
GTTCAATATATAAAATATCTTTACCGTAATCCAAATAGAAATTACTTAACTCAACATTGA
TAAAGTTTTGAACTTCTTGATAAATATTTAAGTAGTCAAAGTTTTCATAGTTGTTAATCG
TACTTGCAGTAAATTCACGTAAACGATTTAGCAAGTAACGATCCACTTCTAATAACTCTG
ATTCAGGAATGCTATCTGTGTCAGGATTGAAATCGTTAATGTTACCTAACATAAATCTTA
ATGTATTTCTGATTTTACGATAAACATCAGATGTTTGTTTTAAAATTTCATCAGAAATTC
TAACATCAGCTAAATAGTCCGTACTACTTACCCAAAGTCTCGCAATATCAGCACCTTTTT
GTTTAACCACTTGGTCAGGTACAATCACATTACCTAAAGATTTACTCATTTTCTTACCTT
CACCGTCCATAACAAAACCATGAGAAAGTAAGAATTTATAAGGTGATACTCCTCTTGTAG
CAACTGAAGTTGTGATAGAAGAGTTGAACCAACCACGATATTGGTCACTACCTTCTAAAT
ACATATCCGCTGGGAAACTTAATTCCGGTCTTGTTTCCAACACGCCACGGTGTGATGAAC
CAGAATCAAACCAAACGTCCATAATGTCTGTTTCTTTAGTAAATGTACCGTTAGGGCTGC
CTGGATGTGTAAATCCTTCTGGTAGTAAGTCTTTCGCTTCTCTTTCAAACCAAATATTTG
AACCGTGTTCTGCAAATAAATCAGCAACATGATTCACTGTTTCTTTCGTCATGATAATTT
CGCCATTTTCAGCATAAAATACTGGTAACGGTACACCCCACACACGTTGACGAGAAATAA
CCCATTCGCCACGGTCACGAACCATATTGTAAATACGTGTTTTACCCCAATTTACTTTGA
AGTTTGTATTTTCGATTGCATCTAAAATATCTTGTCTTACTTTACTGATTGAGGCAAACC
ATTGTGGTGTAGCACGGAAGATTACAGGTTTTTTGTTCTCCAGTCGTGTGGATAGCTAT
GTGTAATAAAGTCTAATTTTAATAGTGCACCTTTTTCTGTTAATAAATCAGTAACGGCTT
TATTAGCTTTATCATAGAACATCCCTTCAAATTGGCCGCCTTCTTCAGTAAATACACCTT
TATCATCGATTGGACTAATTACTGGCAATTCATATTTTTGACCAACAATATAGTCATCTT
```

TABLE 7-continued

CCCCGTGACCTGGTGCTGTATGTACACAACCTGTACCAGCATCTGTAGTAACATGATCAC

CATTAATCACTAACGATTCTCTGTCTAAGAATGGATGTTGTGCTACAACATACTCTAATT

CTTTACCTGTGTATTCTTTTTCTAATTTGATTGATGCTTTATCCCAATCCAGTGCTTCTG

CTACAGCGTCAGACAAGGCTTCTGCAATAATATATTTTTCGCCATTTACATTGTATTGAC

CATATTTTAATTCAGGATGAACGGTAATCGCAACATTTGATGGAATTGTCCATGGCGTTG

TTGTCCAGATAATAAATTTAGCATCTGCATCAACGACACCTTTGTCATCTTTAACGTCAA

ATGCAACGTAAATTGATGCTGAACGTTTATCGTGATATTCAATTTCTGCTTCTGCTAATG

AAGACTCACTTGAAGGAGACCAATAAACTGGCTTTTTACCTTTATAAATTAAACCTTTAT

CTGCCATTTCTCCAAAAATACGAATTTGTGCAGCTTCGTATTCAGGTTTTAATGTAATAT

ATGGATC

LOCUS 101 (GF7)
GATCAAGTTCAAGGTTCATTAGAAATTATTTATAGTTTGCAAGAAGAATTAAAAGAAATT

ACTGGTATGGATGAGGTGACATTACAACCAGCTGCTGGCGCACATGGTGAATGGACTGCA

TTGATGATATTTAAAGCTTACCATGAGAATAATGGTGAAGGTCATCGTGATGAAGTCATT

GTGCCAGATTCTGCGCATGGTACGAATCCAGCCTCAGCTTCATTTGCAGGATTTAAATCA

GTTACTGTAAAATCAAACGAACGTGGCGAAGTTGATATTGATGACTTGAAACGTGTTGTA

AATGAAAATACAGCAGCTATTATGTTAACTAATCCAAACACTTTAGGTATTTTCGAAAAA

AATATTATGGAAATCCGTGAAATCGTCCATAATGCTGGTGGTCTATTATATTATGATGGT

GCGAATTTAAACGCTATTATGGACAAAGTTCGCCCAGGAGATATGGGATTTGATGCTGTT

CATTTAAACTTGCATAAAACATTTACTGGTCCACATGGTGGTGGCGGTCCTGGTTCAGGT

CCAGTCGGTGTAGTAAAAGAACTAGCAAGTTACTTACCAAAGCCAATGGTTATTAAAGAT

GGCGACAAATTTAAATATGATAATGACATTAAAAAATTCTATCGGACGTGTAAAACCATTT

TATGGTAACTTTGGTATTTACTTAAGAGCTTATACGTATATTCGAACTATGGGAGCAACT

GGACTTAAAGAGGTTTCTGAAGCAGCGGTTCTTAATGCGAATTATATTAAAGCACGTTTA

TCTAAACACTTTGAAATACCTTATAAACAATATTGTAAACACGAGTTTGTGTTAAGTGGT

GTGCGTCAAAAAGAATTTGGTGTACGTACTTTAGACATGGCTAAGCGATTATTAGATTTC

GGTGTACATCCACCAACAATATACTTCCCATTAAATGTTGAAGAAGGTATGATGATTGAA

CCGACTGAGACAGAGTCTAAAGAAACACTTGATTATTTTATCGATACATTAATTAGTATT

GCTGAAGAAGCTAAAAATGATCCTGATAAAGTGCTAGAAGCACCACATACAACTGTGATT

GATCGATTAGACGAAGCTACAGCTGCTCGTAAACCAATATTAAAGTTTGAAAATCTTAAA

CAGGAAAAATAAAGTATTAAACACATATTCCGAGAATTATTATTCTAACTTTGTATGAAG

ATTTAAGGATAATGGTTTCAAAATCAATTGAAAAAGACAATTTCTATTTAAACAAGAAAA

CTAAACCGAAGTAATAACTCTTAGGGTTTGGTATTATTCTTTCATAGAAATTGTCTTTTC

ATTTTTTAGATTGCGGTAATTGAATCGTATTGAAAATGAGCTGAACTTTCTTTATTATGC

TGAAACTAAGTTTAATGATC

LOCUS 102 (GF9)
GATCCTGTGTTAACTGGTCGTTAAAAGTGACTTTCGTTTCAGTGTAAAATTTTTCTAATG

TAACAGATATGCTATTATTCATTGAATGATTTAGTGCTTCATCTTTTTTACCCCAATATT

TTATAAGTGCAATATTCGTATGTGCACGTGCTTTGCCACTTTTAATCAACGCATTAACCT

CCTAAATTCTCAATCCAAGTATGTGCTGCACCAGCTTTTTCTACAGCTTTTACAATATTT

TTCGCTGTTGGTAAATCTTTGGCAAGCAATAACATACTTCCACCACGACCAGCGCCAGTA

TABLE 7-continued

AGTTTTCCAGCAATCGCACCATTTTCTTTACCAATTTTCATTAATTGTTCTATTTTATCA

TGACTAACTGTCAACGCCTTTAAATCCGCATGACATTCATTAAAAATATCCGCTAAGGCT

TCAAAGTTATGATGTTCAATCACATCACTCGCACGTAAAACTAACTTACCGATATGTTTT

ACATGTGACATGTACTGAGGGTCCTCACAAAGTTTATGAACATCTTCTACTGCTTGTCTT

GTTGAACCTTTCACACCAGTATCTATAACAACCATATAGCCGTCTAAACTTAACGTTTTC

AACGTTTCAGCATGACCTTTTTGGAACCAAACTGGTTTGCCTGATACAATCGTTTGCGTA

TCAATACCACTTGGTTTACCATGTGCAATTTGCTCTGCCCAATTAGCCTTTTCAATGAGT

TCTTCTTTCGTTAATGATTTCCCTAAAAAATCATAACTTGCACGAACAAAAGCAACCGCG

ACAGCTGCACTCGATCCTAATCCACGTGATGGTGGTAAATTCGTTTGGATCGTTACTGCT

AGCGGCTCTGTAATATTATTTAATTCTACAAAACGGTTCACCAAAGACTTAAGATGGTCA

GGCGCATCATATAACATACCATCGTAAACATCGCTTTTAATAGACGAATAGTTCCCGCTC

TCTAAGGCTTCTATTAAAACTTTGATTTTACCTGCGTTAAACGGTACTGCAATAGCAGGC

TCTCCAAATGTAACAGCATGTTCTCCTATTAAAATAATCTTACCTGTCGATTCCCCATAT

CCTTTTCTTGTCATGTCAATATCACCTTTTATATTTATCCTATACTTGATTCATTATTTT

TATTTATTAGTAAAAGACATCATATTCTAAGTTGCATACGCATTCGCGTTAAATTTCATT

GCAGTCTTTATCTCACATTATTCATATTATGTATAATCTTTATTTTGAATTTATATTTGA

CTTAACTTGATTAGTATAAAACTAACTTTCGTTTACTTCAAAGTTTAAATCTTATCGAGT

GATATTTCAGATTCTTTATCTTTTTATAAAATAGCCCTACAATTTATAATTTTCCACCCT

AACTATAATACTACAAATAATAATTGGAATATATAGATTTACTACTAAAGTATTAGAACA

TTTCAATAGAAGGTCGTTTCTTTCATAGTCATACGCATTATATATACCCTATTCTCAATC

TATTTAATACGTAAAACATGAAATTTTCTTATTAAATTTATTATTTCCATCATATCATTA

CTTTTAATTTAATGATGTTCAATTTAAATATTAGGTCAATAACATATTTATGCTTTTTAT

GGATACTTTCAAAAATAACAGCCCCAAACGATAACTTGAAAGGGGCTGTTAAATATTTAA

CTATTGCATT

LOCUS 103 (GF11)
GATCATTCATTTTAAAGCCAGACTTTTTATAATCTTGTACAAATGCTTGCGCTACATCCT

TGTGTTGATCAAGCAATTCCCCTCTCAGTACTAGCACACAGCAATACGCATCAGGTATAA

CGTCATCACCATGTTTCAAAGTCTTACCTTTGCCTAACTTTTCACCCAGTGCACCGAATG

GTTCGGCTACAGAATACCCTGTAATTCTGTGTTCACTCAATGCGGCTGGCATTTCTGCTG

GCGACATTTCATGATAGCTAAAATGCCCCGGTTTAATCTTTAATTGTTTACGTAATTCCT

CAAGTAAAAGATAATGTGTTGAATAACGATGTGGTATACCAAAATGGTAATCATCGCCAT

TATTATTAAATTCATTTAAGTGCATACCTTTTGTCCCATAATGACATTGCCTTCATGAT

GGCCCAATGCCACAGCCTTTATATTTGAGCCCTTCTGTTTTGATTTCATCGCTAGCTCTA

TTAAAGTTGATGCACCATCAATACGACCACTGTTTAATGCGTCCATTAAATCTGGCCAAT

TATTGAATTTAACTAATTCTAGTTTATATTTCGGATGATTGTATTGTGATAATAATTTTT

TAGTCATCATCAAATTAGCTGAATGTGTAATCGGCAAATATCCAATTTTAATCACTTGCT

GATTTTGGGCATTTTTAGACCGTTCTTTAGACGTCCTTTGCCAATCACATCCTGTAATTA

TAAAGATTCCAATGATGACGATTATGCTTAACCTTTTCATCGTCACTCACTCCTTATAAA

TAATATTCAGGTTCAACTTGATGATGATTCAATGCAAATGTTTCCATAATTTCATTACGA

ATCTTAAGTAGGTGGCTATCATTACGACTGCGTGGATGTGATGCTGTAATTTCATATTGA

TABLE 7-continued

```
GAAATAATATTGCACCCTTCACCTAACAGAACAATGCGGTCGGAAAGATAAATAGCTTCA

TCAATGTCATGCGTCACTAAAATAATAGTTGATTGCGTTTTATGTTTTAGTTGCACTAGT

TGATCCTGAAGTTTATAACGTGTAAATGCATCTAATGCACCTAATGGCTCATCCATCAAT

ATAACGTTAGGCTTATGCACATGCGCTCGACATAGTGCCACACGTTGTTTCATACCCCCG

GACAGTTGCTCGGGAAAATGCTTTCCCCTGTCTTCTAAATCAACTAATTTAAGCTGTGCG

TTAATCTCTTCATCACTAATTTTCTGTTGTAATCCAATCCTAATGTTGTCATTAATCGTT

TTCCATGGCAGCAAATTATGATGTTGAAATAGCATTAAACAATCTGGAGATGGCTGTTGT

TTAATTTCGTTATCAATAATGACACGACCAGACGATGGATGAATAAATCCACCGATAATA

TTGAGTAAAGTAGACTTTCCGCAACCACTTTTCCCTATGAAAGTGACTATTTCTCCCTTG

CTAATGTCCAAATTAAAGTTATGAATTACTTTATGTGATC

LOCUS 104 (GF12)
GATCGCCGATAAGTAAAAACGGTGCATTCATACGTTTCATCATATAATATCCTTCGAAAC

CTTCCGCTGTTCGATAACCACTAAAATATACGTTTAGTGGCGGTTTCATATCACCAGGGT

GGAAATAATAAATAAATTCCTGTCGTTGACTATCTACGAAACGACTACCACCAAGTAAAA

ATTGACCCATGTCTAATCTAGACCATCGTTTGTGTATAGGTCCTAAATGTACCGTCCCGT

TCCCACGCGCCTTAACAGTTACACTTATATAAGCATCAAATGGTTTCGCAGGTATCTCTA

AAGGACTGTCTAACATATCATCAGTCAATACGATTTGTTCAATTAATGCACCATCAGCGC

CAGTCTGAATCAATCTAAATGTATATTGCAACTCGACCGCACCATCAATATCAAATTCTG

GCCATATTTGAATGACTTTATCTTTATCGTAAACGAGATTATTTTGCCAAGATGCGATAG

GTTTAAATTCTTTCCCAAATTCTCCACTCAATGTGAGCTCTGAATTACCTTGGTAAACGA

CATCTCCTTTAAAATTCGGATGCACAAGTGCTAACTTAGGAGAAACCTTATCTCCATACT

GTCCTGAGAAGCTAACTGCCTCTAATTTATTATTACGTTCTTCAATATTCCGGTAATGTA

ATGGTTGAACAACGTATTTTTGGACATTTTCGTCTTGTTCATATTCAACTGACCAAAATG

ATTCATCAACATACGTATTGTATGGTTCGCTTATCATTTGTAATAAATTCGTTAATGTCT

CCGAGTATGGTGCTTGAATATAGATAAAATCAAAGCGCCCTTCTGCTTCAACAATCGCTT

CAATAGCCTCTACATAACCACTATCAAATTCAAACAATCCAATATCGAAGTAATCCCAAC

TCACACCTTTTTGTGTTGAAAAATAGGTTCTAAATCGTCTCCTCCAATTTGCAAAACTC

TAAATTTACGTGGCATCATTTTCACCTTCTATTAACTCATCGAGCTGATTAATAATATTC

TTAGAAGCATATGCATCTATTAATTTTAAAGAATAGGCGTACGCATAATTCCAATTTTTC

AAATAAAATAAATAATAATTTAACGCATCATCTAATTCATCAACTGTATTTATAATACGG

CCATTGTCATAATCAGAGACGTAATCTGTTTGTTGACCATTAATTTGTGGAATCCCAGCG

CTAATTGCACTAATTTGTAAATACAAGTCAGGTTCTTTTGACATATCTATCACAAGTCGC

AACGTCCGCAATGCTTCTACAACATCATGTTCAGCATGTATCGTCTTAACAGCAATGATG

TCATCTTGATC

LOCUS 105 (E18)
ATCAAAAAGTTATGATGAACGTTTTACGCCGGATGAAGTAGTCGCATACCAACAACATCA

AGGTAATAAATTTAAAGAACATTTTGATTTGAATTGTTATCTGACACTGCTAGATGTATT

GGATAGTCACAACATTGACCGAGGTCGCACAGACGTAACGCATGTTTTTAAAAATTTAGA

AACAAAAGTGTTAACGATGGGGTTCATAGATGATTTGCTATATCCGGATGATC

LOCUS 106 (E101)
CTTCTAACATATTAACCCACTCGTTTGTAGCAGCGTTAAAACCAACACCCGGCTCTGCGT
```

TABLE 7-continued

```
TTTTCAAACGTTCTACAATAACAGAACCTTCTAATCCTGCATTTTCAGCAATTTGACGAA
CTGGTGCAGTTAATGCTTTAAGTACAATATTTACACCTGTTTCAATGTCACCTTCAGCTT
CAATTTCACTTACTTTTTGGTAAACATTTACTAATGCAGTACCACCACCTGCAACAATAC
CTTCTTCAACTGCTGCACGTGTAGAATTTAATGCATCTTCAATACGTAATTTACGTTCTT
TAAGCTCTGTTTCACTTGCTGCACCTACTTTGATAACTGCAACACCACCTGCTAATTTAG
CTAAGCGCTCTTGTAATTTTTCACGATC
```

LOCUS 107 (E110)
```
CGATATCTCCAAATTGTCTAATCAAGACCATTTGTACACCTTGCTTATCATTCTTTTTAT
CACTTAGCATATATTGGTATAACGTTTCAAAATCCAAGTCAGTTATCATGTCTAAAGGAT
AGCCGAGTTGTATTAAATATTGAATATAATGATTAATATCATGCTTAGAATCAAACAAAG
CATTCGCAACTATAAATTGATAGATAATGCCAACCATCACTGCATGACCATGAGGTATTT
TATGATAGTATTCAACAGCATGACCAAATGTATGACCTAAATTTAAAAATTTACGTACAC
CTTGTTCTTTTTCATCTGCAATAACAATATCCAGCTTCGTTTCAATACCTTTAGCAATAT
ATTTATCCATACCATTTAATGACTGTAATATCTCTCTATCTTTAAAGTGCTGTTCGATAT
CTTGCGTCGCTGATTCACCATTCAATAACGCATGCTTATAAACTTCTGCATAGCCACTTA
ATATTTGCTCAAATGGTAACGTCTTTAAAAAGACTAAATCATAAATCACAGCAGTTGGAC
GATAAAATGCACCGATAAGGTTTTTACCTTGCTTTGAGTTAATACCCACTTTACCGCCAA
CACTAGAATCATGCGCTAGTATAGTCGTTGGCACTTGTATAAAGTGCACGCCTCGTAAAA
GTGTCGCCGCAATAAACCCAGCAAAATCACCAGTTGCACCACCACCAACAGCAATAATTG
CTGTATTACGAGTTACATGATGGGATAAAATATACTCTAATGTTTCTTGATATTGCTCAA
ATGTTTTCGTCTTTTCACCAGCTGGAATAATAACTTTATGTACATTTTCATATGATAAAA
TATCATCAAATTTATCAGCAAAATATTGATTTACATGCTCGTCAATTAATATAAAACTTT
GATCAAACTGATCAATATACGTGCTAATATGGTCAATTGCACC
```

LOCUS 108 (E125)
```
CACTTTTGAATGTTCACTTCTAAAGATTTGGTCTGTAACTTCCATTTCAGCTAATCCATA
TTTTTCATAAATTTCTTGTCCATAAAGTGTATTTGTATCATGGAATGCTGGTAAACAATG
TAAGAATATCGTTGAATCTTTACCTGTTAAATCAAACATCTGTTGATTCACTTGATAGTC
TTTTAATAAATTAATACGTTGTTCAAATTCACTTTCTTCACCCATCGATACCCAAACATC
TGTATATATAGCATCTGTATTTTCAACTGCTTCTGCAATATTATCCGTAATCATGACTGA
ACCACCATATTGACTCGCTTTTTCTTTTGCAATATCAACATATGCCTCTTTTGGATTTAA
TGATTTAGGTGTACAAATTCTTACATTAACACCTAACATAGCACCTGCTACCATTAATGA
ATGCGCAATATTATTACGTCCATCTCCAACGTAAGTTAAGTTTATTCCTTCTAGATATCC
AAAATTCTCTTTTATTGTCATAAAATCAGCTAACATTTGTGTAGGATGCCAATCGTCTGT
TAATCCATTCCACACCGGTACACCAGAGAACTTCGCTAAATCTTCAACAGCTTGTTGTGA
AAAACCACGGAATTCAATACCATCGAACATTCTACCTAATACTTTCGCAGTATCCTCTAC
AGATTCTTTTTTGCCTAATTGAATATCATTTTTTCCTAAAAATTCTGGATGCGCACCTAA
ATCAATAGACGCAACTGTAAACGCAGCACGCGTTCTCGTCGAATTCTTTTCGAATAGTAG
TGCAATATTTTTCCAGATAAGTAGTGATGCTTAATACCGTTTTTCTTATACTCTTTTAA
TGTAATTGCAAAATCAATAAGTCCTTCGAATTCTGCTTTGGTAAAATCACTTTCTTTTAA
TAATGATCTGCCTTTTAAATCATACGGTTTTTGAATTTCTGTCATTATTTTCACCCTCGT
TTCTATAATTTATTACGTTAAATGTCCTCTCTGAATAATGGTTGACTCATACATCTAGGG
```

TABLE 7-continued

CCCCCACGTCCACGTACCAACTCGCTACCAGATATTTCAATGACTTTAATGCCTTTTTGT

CTCAATAAATCATTCGATACATAGTTTCTATCGTAAGTCACTACAACGCCTGGTCTTATA

CATAATGTATTTGAGCCATCATTCCATTGCTCTCTAGCACCATCAATGACATCACCATTT

CCTGTTGGAATGAATTGGATATCATCTATACCTAGTACGTCTTCTAAAGTATCTTTTAAA

TGACTAGATTGTTTGATGGCAATATCTTTATTTACGTCATCATATTCAATAATAAATATA

TTCATATTGCCTTCTGCCTTTAAAATGGCTGAATGCATTGTAAATTTGTCATAATCTATC

ATTGTAAATACTGTATCTAAGTGCATAAAAGTTCGACTAGTTGGAATTTCAATTGCTACT

ACTTTTTTAAACGTCGCCTGCGGATTTTCAAAAATACGTCGCGCTAACTTTTCAATAGCT

TGTGCAGATGTACGTTCTGAAACGCCTATAGCCAAGACATCTTTAGATAAAACAAGTTCA

TCGCCGCCTTCAATATTGAATGGGCAATCTCGATC

LOCUS 109 (F101)
CAATACCTTGTGGACAAATAAGTATGACATCTTGATTATCTACATTAAAGTAATCTGGGC

ATTCCCACATATATCCAAAATCATCCAACTCTGTATTTATTTCACCTAAATAATGCCAAT

TAATTATATCTTCAGTATTATAAAGTAATAATCGACCTTGCTGATCATTATTTTGTGCAC

CAATGATTGCATAATATTTCTCATCATATTTAAAAACTTTAGGATCTCTAAAATGACTCG

TATATCCTTCTGGTTGTTGGCTAATTACTGGCTTTGGAAACTTTTCAACTGAACCGTCTT

CTTTCAATCGTGCGATCATGTGACTCGCATGTCGTTGCCAATGATTATCTCGATGATTTC

CTGTGTACATATAATATAAATGCCCGTTATATTCAAAAGCGCTACCGCTATATACACCAT

GGCTGTCATATTTAGTATCTGGATTTAAAATTGGCCCTTCAGCTTTAAAGTTTATTAAGT

CATCACTCGTGTAGTTATACCAATACTTTAAGCCATGTACTGCGCCTAATGGGAACCATT

GATGTGAAACATAATACTTCCCTTTATAAAAAATAAGTCCGTTGGGGTCATTTAATAAGC

CTGTTTCTGGTTGTATATGAAATTGTTGACGAAATTTTGATTGATCAACTTGTTGTTTTA

ATGTTTTAAAATACTCAGTATCAACGTCCTCGATTCGTTGATAACGTTCTTCTCTAGTCC

ATTCGGTCATAATATTTACCCAGTCCTCCTTTTATAATTTATGCTGTTAACAATTTATAT

TCTATTATAGCAAATTTTACCTACGTTCTTTAACTTTTAACCTATCCATTTATAGTTATA

TGGTATCGGTTCCACATTTATTTTAAAAAATACAGCGTCTAAATATTAACATCTACTGTG

ACGCTATATGGCATATCTTGCTTTTTAAGCATCTGTTGTATCTCTTCCATCGCGCATTGG

CCAGCTTCAAAATAATTATAATGAATTGTTTTTATCGATGGAGACACTAATTGTGTCATT

GGGTCACCACCAAAACCATATATTTGATGTGGTTTCATAACATCTTTTTTATCAGAATAA

TATTTATAGGCAGCTAATGCAATCGTATCAGTTGCTCCAACAACCGCATCTACTTGCTCC

ACATTTTCCAAAACATTTGCAACATCTTTTTGTGCTTCCACATAAGTAAAATTTGTTTCA

TGTATATTAGGTTTAATTTGGTATTTAGCTAACTGGTCAAGTAAACCACGTTTTCTATGT

ATACCAACTGCAATATCTTTTTCACTTACACTAAACACTTCAACTTGTTGATATCCCTGT

TGACCAATCCATTCGCCTATAATTTGACCTGCTTTATAATCATCATGCACAATACTATGA

AGTTGTTCATGTTGTTGACCAACAATAACGATTGGTACATTCATTTTATTAATGACTTCA

ATATGTCTCTGTTATGTCTGTAGCCATTAAAACAATACCATCTACTTTACTGCGTGCT

AATGTTTCAAGCGCTTGTATTTCTGCTTCGATATTTAAACCTGTGTAATTTAAAATTAAT

TGTGATTCATATTTTTGGCATTGTTTTGCCAATCCTTTGATTGTTTCATCTACTGCATAT

GAATTCATTCTAGGTATAATGGCACCAATAAGGTGTGTTTGTCTCGCTCTTAAACTTTGA

GCAAATTGATTCGGTTGATAGTCATGTTCTGCTATAATTCTTGTTAATTTTTCACTTGTT

TABLE 7-continued

```
TTTTTACTGACAGATCCATTATTTAAAAATCTAGATACTGTACTTTTTGAAACGCCTGCC
AATTTGGCAATATCAGATATATTTTTCATACTTATTCACCTATCATTATTTGTGACACTT
AGCCTTATTTTAGCATATGTGTAACCGCTTTAAATAATATTTCTGCTTCTTTCATAAAAA
GATTTCAAAATAAAACTTTTGTATAACAAAATGTCCCAACATCAACCTTTAGTTAAATGT
CAGGACAATGAATATTCTATGTAAATATATTCTAATATCGAATATGTTTATTGAATCTAT
TTAGCTCACCTTCAAAGTAAGCATGTTCACCGTGAACAATCTTGTCTAATCCTATATTCG
TTTCTTGTTCCGTAACAGATAATGGTGTAATTAATTTAATTACTTTCGCAATAATAAACG
TCATGACTATACTAAAAATTACAACTGCTGTTACACATAATATTTGTACAAGTATAATAT
GTATGTCACCAGTATAAATAAAGCCATTCTCAATGTCAGGATTGGCTTTTTTACTTTGGA
AAACTGCTGTTAAAACAGCACCAATAATACCACCAACACCATGAATACCAAATGCATCTA
ATGCATCATGATATTTTAGTTTTACCTTGATGTAATTAATGACAATATAACAACAGATAC
CTCCTATTAAAGCCATTATTGTTGCACTAAGATATGTTACATATCCTGCTGCAGGAGTAA
TGACAACTAATCCTGCTAATGCACCGAGTAAAAGTCCAAGTAAACTTGTCGTCTTTTTAA
AAATATATTCTAAAATTAACCAACCTATAGCACCTGCACTGGCTGAAATGACAGTATTTG
TAAATGCAAGCATCGCAATATTATCAAATGTAAAAGCACTACCTACATTAAATCCATACC
AACCAATCCACACGAATATACCGCCAATCAACGTAATGATAAGATTATGTGGTGTTGATT
CAGAATGTTTGTTTCCTTTTCCAATCATAATAGCTAATACTAAACCAGAAACACCTGATG
TAATATGAACAACCGTACCTCCAGCGAAATCTAATACACCGAGTTTGTTAATCCAACCGC
CGCCCCAAACCCAATGTGCTACTGGACTGTATACAAGAGCAGTCCATATTACTACGAATA
ATAAATAAGGAATAAACTTCATTTTCTCAGCGATTGAACCAGATAAAATAGAAATTGCAA
TCGTACAAAACATCATTTGAAATAACATAAACAAAGCGAAAGGAATATGTGGGCTAATAT
CTTCTTGAGTCGCAAAACCTACATGATTAAGAAAAGTATATTCCCAATTTCCGAACCATA
AATTCCCATTCCCAAAACTAATTGTAAAACCAACTGTTATCCATACAAATGTAACAAGCA
CAATTGCTGCCATACTTTGCATGACAGTATTAAGCGCATTTTTAGATTGAACTAACCCAC
CATAAAATAAACTTAATCCTGGTGTCATTAACCAAACTAATAATGTACACAAAAACATAA
ATATCGTATCGTTAAGATTCATACTTACCACTCCCTTTTTTTCATAATAATCTGACAATT
TATAAAAAGCAAAAATGCGTTAAGTTTTATTACATCTTTTGGAATAAAATGTGCCACACT
ATATAAAAATGATTTCATGAACTAAAAAAAAAAAGACTACTTACTCACTTTTAAATTAGC
GGAAGTAGCCATAGAATCTAATATCTATTTTATTGTTAAAATGATAACGTTAAACTTTTT
GAATTGTAATTGTCCATGAAGCATTATCAATTTGTTCATAGTTTGTTACAGGATAACCAT
TTTCTGCAGCCCAATTTGGAATGGCTTCCGTCGCTTGCGTGCAATCAAAATCAATTTTTA
ATTCATCTCCAGATTGCAATGTTGCCATTTTCTTTTGCGCTTCAATTAACGGAAATGGAC
ATACCATTCCTACTGTACCTAATTCGTGTATCATAATTATTTCTCCTTTTCCAATCACTT
TTATTTGATC
LOCUS 110
GTCTCTTTCAACAACCGCGTCATATTTTTCAACATAACCTTTTTTGATAAGTCCATCTAA
ACTGGATTTTGAAAAGCCCATATCCTCAATATCAGTTAAAAATATTGTTTTATGTTGTTC
TTCAGACAAGTAAGCATACAAATCGTATTGTTTAATAACTTTCTCCAACTTAGCTAATAC
TTCATCAGGATGATACCCTTCAATGACACGAACAGCACGCTTGGTTTTTTTAGTTATATT
TTGTGTGAGAATCGTTTTTTCTTCAACGATATCATCTTTTAACAACTTCATAAGCAATTG
```

TABLE 7-continued

```
AATATCATTATTTTTTTGCGCATCTTTATAATAATAGTAACCATGCTTATCAAATTTTTG
TAATAAAGCTGAAGGTAGCTCTATGTCATCTTTCATCTTAAATGCTTTTTTATACTTCGC
TTTAATAGCACTCGGAAGCATCACTTCTAGCATAGAAATACGTTTAATGACATGAGTTGA
ACCCATCCACTCACTTAAAGCTATTAATTCTGATGTTAATTCTGGTTGTATATCTTTCAC
TTCTATGATTTTTTTTAACTTCGAAACGTCAAGTTGTGCATCAGGTTCTGCTGTTACTTC
CATTACATAACCTTGAATCGTTCTTGGTCCAAAAGGTACAATTACACGCACACCAGGTTG
GATGACAGATTCGAGTTGTTCGGGAATTATATAATCAAATTTATAGTCAACGCTCTTCGA
CGCGACATCGACTATGACTTTCGCTATCATTATTGCCAC
LOCUS 111
GCGTTGTGAATTAGTATAATCAATTTACTGGAAGATATTTAGTCGATTGATACCTATCAA
CTATTTTCAGCATACGATAAATTATAACAAATCATAGTTTATTATCACACTTAATTATTA
TATTTTTCAAGGGAGAATACCAAATATGCCTAAAAATAAAATTTTAATTTATTTGCTATC
AACTACGCTCGTATTACCTACTTTAGTTTCACCTACCGCTTATGCTGATACACCTCAAAA
AGATACTACAGCTAAGACAACATCTCATGATTCAAAAAAATCTAATGACGATGAAACTTC
TAAGGATACTACAAGTAAAGATATTGATAAAGCAGACAAAAATAATACAAGTAACCAAGA
CAATAACGACAAAAAATTTAAAACTATAGACGACAGCACTTCAGACTCTAACAATATCAT
TGATTTTATTTATAAGAATTTACCACAAACCAATATAAACCAATTGCTAACCAAAAATAA
ATACGATGATAATTACTCATTAACAACTTTAATCCAAAACTTATTCAATTTAAATTCGGA
TATTTCTGATTACGAACAACCTCGTAATGGCGAAAAGTCAACAAATGATTCGAATAAAAA
CAGTGACAATAGCATCAAAAATGACACTGATACGCAATCATCTAAACAAGATAAAGCAGA
CAATCAAAAAGCACCTAAATCAAACAATACAAAACCAAGTACATCTAATAAGCAACCAAA
TTCGCCAAAGCCAACACAACCTAATCAATCAAATAGTCAACCAGCAAGTGACGATAAAGC
AAATCAAAAATCTTCATCGAAAGATAATCAATCAATGTCAGATTCGGCTTTAGACTCTAT
TTTGGATCAATACAGTGAAGATGCAAAGAAAACACAAAAAGATTATGCATCTCAATCTAA
AAAAGACAAAAATGAAAAATCTAATACAAAGAATCCACAGTTACCAACACAAGATGAATT
GAAACATAAATCTAAACCTGCTCAATCATTCAATAACGATGTTAATCAAAAGGATACACG
TGCAACATCATTATTCGAAACAGATCCTAGTATATCTAACAATGATGATAGCGGACAATT
TAACGTTGTTGACTCAAAAGATACACGTCAATTTGTCAAATCAATTGCTAAAGATGCACA
TCGCATTGGTCAAGATAACGATATTTATGCGTCTGTCATGATTGCCCAAGCAATCTTAGA
ATCTGACTCAGGTCGTAGTGCTTTAGCTAAGTCACCAAACCATAATTTATTCGGTATCAA
AGGTGCTTTTGAAGGGAATTCTGTTCCTTTTAACACATTAGAAGCTGATGGTAATCAATT
GTATAGTATTAATGCTGGATTCCGAAAATATCCAAGCACGAAAGAATCACTAAAAGATTA
CTCTGACCTTATTAAAAATGGTATTGATGGCAATCGAACAATTTATAAACCAACATGGAA
ATCGGAAGCCGATTCTTATAAAGATGCAACATCACACTTATCTAAAACATATGCTACAGA
TCCAAACTATGCTAAGAAATTAAACAGTATTATTAAACACTATCAATTAACTCAGTTTGA
CGATGAACGCATGCCAGATTTAGATAAATATGAACGTTCTATCAAGGATTATGATGATTC
ATCAGATGAATTCAAACCTTTCCGTGAGGTATCTGATAGTATGCCATATCCACATGGCCA
ATGTACTTGGTACGTATATAACCGTATGAAACAATTTGGTACATCTATCTCAGGTGATTT
AGGTGATGCACATAATTGGAATAATCGAGCTCAATACCGTGATTATCAAGTAAGTCATAC
ACCAAAAACGTCATGCTGCTGTTGTATTTGAGGCTGGACAATTTGGTGCAGATCAACATTA
```

TABLE 7-continued

CGGTCATGTAGCATTTGTTGAAAAAGTTAACAGTGATGGTTCTATCGTTATTTCAGAATC

CAATGTTAAAGGATTAGGTATCATTTCTCATAGAACTATCAACGCAGCTGCCGCTGAAGA

ATTATCATATATTACAGGTAAATAAGTATTATATTAAACCCGTAAAATTTATAAGTATAA

ACAAGGAGTTCGGACTTAAACATATTTCTGTTCATAAGTCCGATTTCTTATTCAATTAAA

CCCGAGGCATTCAGTTCGAACGCCTCGGGTCGTTTTATATAAATATATTATTTTATGTTC

AAATGTTCCTCATCATATCCGTTTCAATTGCCATCTCACACATTTTATAAATATGAGCAA

ATGTACTTATTCTCAAACATTACTGCCGAGCTTTAATTGACGTTATATTAACTATAAACT

ACTTTTCCATGACTCTACGGATTCAATGTCACATGAGCGTGATAAAATTTGTTCAATAAT

AAAGTCATGTTTATCATCTGA

ATAATATTTAAGCCTACACTAGCTAACATACCAATCATAGAAACCATTGGTGCCCCAATT

GCACGTGCAAATTGTTCTAATATGAAGAACAAAATTACAAAAGGTGCACTTAAAAACATT

ACTTTCAAATAATTACTTGTTAAAGCTAACGTTTCACCTCTCGCCCCTAAAATTGCTGCG

ATTTGATCACTGAATGGTAAAGTAACTAAAATCACGATAAGTCCTAGTGCAATACCACCA

TAAATAGAGAAACTACTTACAAATTTACTCTTACTATAGTCTTTCGCACCTAATAAACGT

GAAATATAAGTTCCTGCACCAACGCCAAATAAATTACCTAACCCCATTAAGATAGCAAAT

ACTGGCAGTGTTAGAGAGATAGCAGAAATCATGTGGCTATCTTCTAAAAATCCTATAAAG

TAAATATTTAATATGCCATAAATAACGCTTAATAAAGTCCCTATCATCATTGGCAATGAG

AAATGCATCATCGCTTTAAATACTGGCGATTTCTCAAAATAATATAATTGTTCGTCTTTC

ATTGTTCAATACTCCTTGTCTTTTCCAATAATTAGCTTACTAACAATTAGATATCTAACT

ATAATATTAAAGACAAAGTGACTGATTTCTACCAGTCACACTTATCATTTATTGTAAACT

AGATAACATTTTAGTTAAGTTTGCTTTCATTTGTTCATTTTCTTCTTCAGATAACTGCGA

TACGAGTGTTTGTTCCATTTCATCAAATATCGAAGTGAATGCTTCTACGAGTTTAATCCC

AGAGGTAGTCAGCCCTATATTCTTTCTTCTCGTATCTTGTGCATCGACATAGCGATAGAT

CAGCTTTTTACGTTCAAGGTTCCTTAATAAATTACTGACAGTTGGACCTGTTCGTTGTAA

TGCTTTAGCAATATCATTTTGTGTCAGTCCATCTTGTTGATGTGCATAAAGATAACCTAA

CGTATGACCTTG

LOCUS 113
GATCCTTCAGAAATCAATAAAGTTATTCATGTAGATTTAGGTATTATTGCAGACTGTAAA

AGATTTTTAGAATGTTTAAATGATAAAAATGTTGAGACTATAGAACACAGTGACTGGGTT

AAACATTGTCAAAATAATAAGCAGAAACACCCATTTAAACTTGGTGAAGAAGATCAAGTA

TTTTGTAAGCCACAACAAACAATCGAATATATCGGCAAAATTACAAATGGTGAAGCAATT

GTTACTACAGACGTGGGACAACATCAAATGTGGGCAGCTCAATTTTATCCATTTAAAAAT

CACGGACAATGGGTTACAAGCGGTGGTTTAGGAACAATGGGATTCGGTATTCCTTCGTCA

ATTGGTGCCAAATTAGCTAATCCTGATAAAACAGTCGTATGTTTCGTCGGTGACGGTGGT

TTCCAAATGACAAACCAAGAAATGGCACTTTTACCCGAATATGGTTTAGATGTCAAAATC

GTACTAATCAATAATGGAACATTAGGTATGGTTAAACAATGGCAAGATAAGTTCTTTAAT

CAACGCTTCTCACACTCAGTATTTAATGGTCAACCTGATTTTATGAAAATGGCAGAAGCA

TATGGCGTCAAAGGTTTCTTAATCGATAAGCCAGAACAACTGGAAGAACAATTAGATGCA

GCGTTTGCTTATCAAGGACCAGCTTTAATTGAGGTTCGTATTTCCCCTACTGAAGCTGTA

ACCCCAATGGTTCCGAGTGGCAAATCAAATCATGAAATGGAGGGCTTATAATGACAAGAA

TABLE 7-continued

TTCTTAAATTACAAGTTGCGGATCAAGTCAGCACGCTAAATCGAATTACAAGTGCTTTTG

TTCGCCTACAATATAATATCGATACATTACATGTTACACATTCTGAACAACCTGGGATTT

CTAACATGGAAATTCAAGTCGATATTCAAGATGATACATCACTTCATATATTAATTAAAA

AATTAAAACAACAAATTAATGTTTTAACGGTTGAATGCTACGACCTTGTTGATAACGAAG

CTTAATTTTAAGACAAAGGCAATGATGCGCTAATTAGTTATAGATATATCATAGGCTGCT

AGTTAACATCTGCCACTATTACAAAGTTATATTTCAGAATTTTCGAAACACAAAATATTT

AATTATTTGGAGGAATTTATTATGACAACAGTTTAT

LOCUS 114
GCGCACCAAACTCTCGTCCAATTGATTTTGAAATGAAAAAGAAAGATGGAACTCAACAGT

TTTATCATTATGCAAGTTCTGTTAAACCTGCTAGAGTTATTTTCACTGATTCAAAACCAG

AAATTGAATTAGGATTACAATCAGGTCAATTTTGGAGAAAATTTGAAGTTTATGAAGGTG

ACAAAAGTTGCCAATTAAATTAGTATCATACGATACTGTTAAAGATTATGCTTACATTC

GCTTCTCTGTATCAAACGGAACAAAAGCTGTTAAAATTGTTAGTTCAACACACTTCAATA

ACAAAGAAGAAAAATACGATTACACATTAATGGAATTCGCACAACCAATTTATAACAGTG

CAGATAAATTCAAAACTGAAGAAGATTATAAAGCTGAAAAATTATTAGCGCCATATAAAA

AAGCGAAAACACTAGAAAGACAAGTTTATGAATTAAATAAAATTCAAGATAAACTTCCTG

AAAAATTAAAGGCTGAGTACAAGAAGAAATTAGAGGATACAAAGAAAGCTTTAGATGAGC

AAGTGAAATCAGCTATTACTGAATTCCAAAATGTACAACCAACAAATGAAAAATGACTG

ATTTACAAGATACAAAATATGTTGTTTATGAAAGTGTTGAGAATAACGAATCTATGATGG

ATACTTTTGTTAAACACCCTATTAAAACAGGTATGCTTAACGGCAAAAAATATATGGTCA

TGGAAACTACTAATGACGATTACTGGAAAGATTTCATGGTTGAAGGTCAACGTGTTAGAA

CTATAAGCAAAGATGCTAAAAATAATACTAGAACAATTATTTTCCCATATGTTGAAGGTA

AAACTCTATATGATGCTATCGTTAAAGTTCACGTAAAAACGATTGATTATGATGGACAAT

ACCATGTCAGAATCGTTGATAAAGAAGCATTTACAAAAGCCAATACCGATAAATCTAACA

AAAAAGAACAACAAGATAACTCAGCTAAGAAGGAAGCTACTCCAGCTACGCCTAGCAAAC

CAACACCATCACCTGTTGAAAAAGAATCACAAAAACAAGACAGCCAAAAAGATGACAATA

AACAATTACCAAGTGTTGAAAAAGAAAATGACGCATCTAGTGAGTCAGGTAAAGACAAAA

CGCCTGCTACAAAACCAACTAAAGGTGAAGTAGAATCAAGTAGTACAACTCCAACTAAGG

TAGTATCTACGACTCAAAATGTTGCAAAACCAACAACTGCTTCATCAAAAACAACAAAAG

ATGTTGTTCAAACTTCAGCAGGTTCTAGCGAAGCAAAAGATAGTGCTCCATTACAAAAAG

CAAACATTAAAAACACAAATGATGGACACACTCAAAGCCAAAACAATAAAAATACACAAG

AAAATAAAGCAAATCATTACCACAAACTGGTGAAGAATCAAATAAAGATATGACATTAC

CATTAATGGCATTATTAGCTTTAAGTAGCATCGTTGCATTCGTATTACCTAGAAAACGTA

AAAACTAATAAATCGTCTTTATATTTAATTATTAAATTAACAAATTTTAATTGGCGGATG

AGGTATCCAGTTACCTCGTTCGCCAATTATTTTTCGCAATATAAAAAGTCCCACTTAAAA

CAATCATTTTAAGCGGGACTTTTTATATTGAGTAACTAAAATTATTTAGCTGCTACTTCT

TCGCCATTGTAAGAACCACAGTTTTTACATACACGGTGTGATAATTTGTATTCGACCACA

GTTTGGGCATTCAGTCATACCTGGTACTGAAATTTTGAAATGCGTACGACGTTTGTTTTT

TCTAGTTTTAGAAGTTCTTCTTTTTGGTACTGCCATGATATATCCTCCTTAGATTATAAA

CGAAAAATACTAAATGTTAGTTTAATTAACAACATTATATCATTAATTAAACTACTTATT

TABLE 7-continued

```
GCTCTTTATCATATAATTGTTGTAATTTTTGAAGCCTTGGATCAACTTGTCGTGATTCTG

AATCATCTTGTTGCTTGCTGTTTAGCAAGCTCATCTAATTGATCCTCATCGATTACTTCC

CAACCATTACCTACTGTCAACATTTGGTCACTTTGCTCTGAATAAGCTCTCATTGGTTTC

TCAATAATAACTATATCCTCGACAATATCCTGAAGATTAACCATACCATCTTTAATAATG

TGATAGTGTTCATCTACATCATCTTGATC

LOCU9 115
GGATCTGATATTTTATCAATGTGCTTGTCATCTTTTTTAATATCATCTAACGTTTTCTTA

ATATCTTTAGTAATGTTCGGTTGCACAATACCATCATCTTTAGTCGTCTTAAAGACAACA

CGTATTTGTGCCTTTTCACTATCTTGATTAAAATGTTTTTCAATCTTTTTATTCGTATCT

AACGACTCTAATCCTGTCATTTTAATATCATTGTCAAATTTCGGTGCATTTGTAGCAAGT

GGTATCAATATTGCAGCTACAATCACTATCCATGCAATGACCGCGGACCATTTATGTTTT

GCGATGAATGTCCCCATCTTATATAAAATTTTGCCAAAGTATATTGCCTCCTTTTAAAA

TCAACGTTATAGTTTAAATATACAGTGTAGATTATTGTTCGATTATAGTATCTATCCCCG

ACCTCTTAAAGAATCAATTGGAAAATTTTGTATATTAAACTACACACAAAGGAGAAATGT

AGATGAAAGAGACTGATTTACGAGTTATAAAGACAAAAAAGCATTGTCGAGTAGCTTGC

TACAATTGTTAGAACAGCAATTATTCCAAACGATTACTGTCAATCAAATTTGCGACAACG

CACTCGTACACCGTACAACATTTTATAAACATTTTTATGATAAATATGATCTTCTAGAGT

ACTTGTTCAATCAATTGACTAAAGACTACTTTGCTAGAGATATCAGTGACCGTCTTAATC

ATCCATTCCAAACGATGAGTGATACGATTAATAATAAAGAGGATTTGAGAGAAATCGCAG

AATTCCAAGAAGAAGACGCTGAATTTAATAAAGTATTAAAAAATGTCTGCATTAAAATTA

TGCATAACGATATCAAAAATAATAGAGACCGTATCGATATTGACAGCGACATCCCAGATA

ATCTCATATTTTATATTTATGACTCGTTGATTGAAGGTTTTATACATTGGATAAAAGATG

AAAAAATTGATTGGCCTGGCGAAGATATTGATAACATTTTCCATAGATTAATCAATATTA

AGATTAAATAGTAGATGAGAAACTCATGAGCGTTACCAACATTCATAATAAAAACGATAG

TGTACACGTTAATGAATTCGTGTACTACTATCGTTTTTATTTTTATCGTGCTTATCGCT

ATTAAAACAACTGATACACAACACATAAACTATGAAGAAAAAATAAATCCGCTATCTAA

ATGACTTTGACTCAGTTGTTTAAATGACCAAATTGCTAATACAATTCCCATTATTATTGA

AATAACGTATCTCACATTCTTATACCTATAATCCTTTTCTAAAAATATGGTTGCTATTAC

TTAATTTTTAAAGTTATAAATAAAAAGAGCCAACCGCAATGGATGGCCCTTGTTCATTAT

GAAGCATTAGAACATTTCTGAAACAACCTTTTGTTCTAAGAAGTGTAATAAGTAGTCTGG

ACTACCTGTTTTAGCGTCCGTACCTGACATTTTGAAACCACCAAATGGATGGTATCCAAC

AACTGCTGAAGTACAGCCTCTGTTAAGGTATAAATTGCCTACATCAAATTCGTTTACCGC

TTTAATCCAATGCTCGCGATTATTTGTAATCACTGCACCAGTTAAACCGTAATCTGTATC

ATTTGCAACCTCAATTGCTTCATCAAAATCGTTAACTTTCACAAAGCCAACAACTGGACC

AAAAATTTCTTCTTGCATGATTCTATCTTTAGATTTAAGTCCTGAAATGATTGTTGGTTC

TACAAAGTAACCTTTTGAATCATCAGTGCCGCCACCTTGTTCTAATTTACCTTCTTCTTT

ACCAATCTCAATATAATTTTTAATCTTATCAAATTGTTTTTTATTAATAACTGGGCCCAT

ATACGTATTGTCTACAGTATTGCCCAACGTTAATTCTTTTGTTAATTTGATTGATTTCTC

TAATACTTCGTCATAAACGTCTTTATGCACAATTGCACGTGAACATGCTGAACATTTTTG

ACCAGAAAAACCAAATGCTGACGTTACAATAGCTTCTGCTGCCATATCTGTATCAATATT
```

TABLE 7-continued

```
TTCATCAACTACAATGGCATCTTTACCACCCATTTCAGCGATAACACGTTTCAAGAAGTT

TTGACCTTCTTGAACAACGGCACTACGTTCATAAATTCTAGTACCTGTCGCACGTGATCC
```

TABLE 8

LOCUS 1 (E8/B1/I16)
>G1832_STAAU8325, UNDEFINED PRODUCT 1724158:1725096 REVERSE
MW: 34671
MEHTTMKITTIAKTSLALGLLTTGVITTTTQAANATTLSSTKVEAAQSTPPSTKIEAPQS

KPNATTPPSTKVEAPQQTANATTPPSTKVTTPPSTNTPQPMQSTKSDTPQSPTTKQVPTE

INPKFKDLRAYYTKPSLEFKNEIGIILKKWTTIRFMNVVPDYFIYKIALVGKDDKKYGEG

VHRNVDVFVVLEENNYNLEKYSVGGITKSNSKKVDHKAGVRITKEDNKGTISHDVSEFKI

TKEQISLKELDFKLRKQLIEKNNLYGNVGSGKIVIKMKNGGKYTFELHKKLQENRMADVI

DGTNIDNIEVNIK

>G1834_STAAU8325, UNDEFINED PRODUCT 1725193:1725327 REVERSE
MW: 5264
MFVKVAFLCLKSDETSNVPSVESHQNHFYLTNIMDFLTILTMIGI

>G1835_STAAU8325, UNDEFINED PRODUCT 1725449:1726531 REVERSE
MW: 40775
MEHTIMKMRTIAKTSLALGLLTTGATIVTTQSVKAEKIQSTKVDKVPTLKAERLAMINIT

AGANSATTQAANTRQERTPKLEKAPNTNEEKTSASKIEKISGPKQEEQKTLNISATPAPK

QEQSQTTTESTTPKTKVTTPPSTNTPQPMQSTKSDTPQSPTIKQAQTDMTPKYEDLRAYY

TKPSFEFEKQFGTMLKPWTTVRFMNVIPNRFIYKIALVGKDEKKYKDGPYDNIDVFIVLE

DNKYQLKKYSVGGITKTNSKKVNHKVELSITKKDNQGMISRDVSEYMITKEEISLKELDF

KLRKQLIEKHNLYGNMGSGTIVIKMKNGGKYTFELHKKLQEHRMADVIDGTNIDNIEVNI

K

>G1837_STAAU8325, UNDEFINED PRODUCT 1726810:1727562 REVERSE
MW: 28926
MYDSNYVIKQSNYNRLEHTTMKMKNIAKISLLLGILATGVNTTTEKPVHAEKKPIVISEN

SKKLKAYYNQPSIEYKNVTGYISFIQPSIKFMNIIDGNSVNNIALIGKDKQHYHTGVHRN

LNIFYVNEDKRFEGAKYSIGGITSANDKAVDLIAEARVIKEDHTGEYDYDFFPFKIDKEA

MSLKEIDFKLRKYLIDNYGLYGEMSTGKITVKKKYYGKYTFELDKKLQEDRMSDVINVTD

IDRIEIKVIKA

LOCUS 2 (B10/I15)
>G0678_STAAU8325, UNDEFINED PRODUCT 661503:665291 FORWARD
MW: 138168
MLGVINRMAKKFNYKLPSMVALTLVGSAVTAHQVQAAETTQDQTTNKNVLDSNKVKATTE

QAKAEVKNPTQNISGTQVYQDPAIVQPKTANNKTGNAQVSQKVDTAQVNGDTRANQSATT

NNTQPVAKSTSTTAPKTNTNVTNAGYSLVDDEDDNSENQINPELIKSAAKPAALETQYKT

AAPKAATTSAPKAKTEATPKVTTFSASAQPRSVAATPKTSLPKYKPQVNSSINDYICKNN

LKAPKIEEDYTSYFPKYAYRNGVGRPEGIVVHDTANDRSTINGEISYMKNNYQNAFVHAF

VDGDRIIETAPTDYLSWGVGAVGNPRFINVEIVHTHDYASFARSMNNYADYAATQLQYYG

LKPDSAEYDGNGTVWTHYAVSKYLGGTDHADPHGYLRSHNYSYDQLYDLINEKKLIKMGK

VAPWGTQSTTTPTTPSKPTTPSKPSTGKLTVAANNGVAQIKPTNSGLYTTVYDKTGKATN

EVQKTFAVSKTATLGNQKFYLVQDYNSGNKFGWVKEGDVVYNTAKSPVNVNQSYSIKPGT

KLYTVPWGTSKQVAGSVSGSGNQTFKASKQQQIDKSIYLYGSVNGKSGWVSKAYLVDTAK

PTPTPTPKPSTPTTNNKLTVSSLNGVAQINAKNNGLFTTVYDKTGKPTKEVQKTFAVTKE

ASLGGNKFYLVKDYNSPTLIGWVKQGDVIYNNAKSPVNVMQTYTVKPGTKLYSVPWGTYK

TABLE 7-continued

QEAGAVSGTGNQTFKATKQQQIDKSIYLFGTVNGKSGWVSKAYLAVPAAPKKAVAQPKTA

VKAYTVTKPQTTQTVSKIAQVKPNNTGIRASVYEKTAKNGAKYADRTFYVTKERAHGNET

YVLLNNTSHNIPLGWFNVKDLNVQNLGKEVKTTQKYTVNKSNNGLSMVPWGTKNQVILTG

NNIAQGTFNATKQVSVGKDVYLYGTINNRTGWVNAKDLTAPTAVKPTTSAAKDYNYTYVI

KNGNGYYYVTPNSDTAKYSLKAFNEQPFAVVKEQVINGQTWYYGLKSNGKLAWIKSTDLA

KELIKYNQTGMTLNQVAQIQAGLQYKPQVQRVPGKWTDAKFNDVKHAMDTKRLAQDPALK

YQFLRLDQPQNISIDKINQFLKGKGVLENQGAAFNKAAQMYGINEVYLISHALLETGNGT

SQLAKGADVVNNKVVTNSNTKYHNVFGIAAYDNDPLREGIKYAKQAGWDTVSKAIVGGAK

FIGNSYVKAGQNTLYKMRWNPAHPGTHQYATDVDWANINAKIIKGYYDKIGEVGKYFDIP

QYK

LOCUS 3
>G1419_STAAU8325, UNDEFINED PRODUCT 1379120:1380817 FORWARD
MW: 61188
DRKPVTVAKLKVEGALAMILKDAIKPNLVQSIEGTPALVHGGPFANIAHGCNSILATETA

RDLADIVVTEAGFGSDLGAEKFMDIKAREAGFDPAAVVVVATIRALKMHGGVAKDNLKEE

NVEAVKAGIVNLERHVNNIKKFGVEPVVAINAFIHDTDAEVEYVKSWAKENNVRIALTEV

WEKGGKGGVDLANEVLEVIDQPNSFKPLYELELPLEQKIEKIVTEIYGGSKVTFSSKAQK

QLKQFKENGWDNYPVCMAKTQYSFSDDQTLIGAPSGFEITIRELEAKTGAGFIVALTGAI

MTMPGLPKKPAALNMDVTDDGHAIGLF

>G1420_STAAU8325, UDEFINED PRODUCT 1381154:1383838 FORWARD
MW: 100947
MNKHHPKLRSFYSIRKSTLGVASVIVSTLFLITSQHQAQAAENTNTSDKISENQNNNATT

TQPPKDTNQTQPATQPANTAKNYPAADESLKDAIKDPALENKEHDIGPREQVNFQLLDKN

NETQYYHFFSIKDPADVYYTKKKAEVELDINTASTWKKFEVYENNQKLPVRLVSYSPVPE

DHAYIRFPVSDGTQELKIVSSTQIDDGEETNYDYTKLVFAKPIYNKPSLVKSDTNDAVVT

NDQSSSVASNQTNTNTSNQNISTINNANNQPQATTNMSQPAQPKSSTNADQASSQPAHET

NSNGNTNDKTNESSNQSDVNQQYPPADESLQDAIKNPAIIDKEHTADNWRPIDFQMKNDK

GERQFYHYASTVEPATVIFTKTGPIIELGLKTASTWKKFEVYEGDKKLPVELVSYDSDKD

YAYIRFPVSNGTREVKIVSSIEYGENIHEDYDYTLMVFAQPITNNPDDYVDEETYNLQKL

LAPYHKAKTLERQVYELEKLQEKLPEKYKAEYKKKLDQTRVELADQVKSAVTEFENVTPT

NDQLTDLQEAHFVVFESEENSESVMDGFVEHPFYTATLNGQKYVVMKTKDDSYWKDLIVE

GKRVTTVSKDPKNNSRTLIFPYIPDKAVYNAIVKVVVANIGYEGQYHVRIINQDINTKDD

DTSQNNTSEPLNVQTGQEGKVADTDVAENSSTATNPKDASDKADVIEPESDVVKDADNNI

DKDVQHDVDHLSDMSDNNHFDKYDLKEMDTGIAKDTDRNVDKDADNSVGMSSNVDTDKDS

NKNKDKVIQLNHIADKNNHTGKAAKLDVVKQNYNNTDKVTDKKTTEHLPSDIHKTVDKTV

KTKEKAGTPSKENKLSQSKMLPKTGETTSSQSWWGLYALLGMLALFIPKFRKESK

>G1421_STAAU8325, UNDEFINED PRODUCT 1383972:1384061 FORWARD
MW: 3459
MKIILLLFTLIFGFIVVVTLKSEHQLTLFSI

LOCUS 4 (E103)
>G2652_STAAU8325, UNDEFINED PRODUCT 2537955:2540798 REVERSE
MW: 104512
LHLRENIIVKSNLRYGIRKHKLGAASVFLGTMIVVGMGQEKEAAASEQNNTTVEESGSSA

TESKASETQTTTNNVNTIDETQSYSATSTEQPSQSTQVTTEEAPKTVQAPKVETSRVDLP

SEKVADKETTGTQVDIAQPSNVSEIKPRMKRSTDVTAVAEKEVVEETKATGTDVTNKVEV

TABLE 7-continued

EEGSEIVGHKQDTNVVNPHNAERVTLKYKWKFGEGIKAGDYFDFTLSDNVETHGISTLRK

VPEIKSTDGQVMATGEIIGERKVRYTFKEYVQEKADLTAELSLNLFIDPTTVTQKGNQNV

EVKLGETTVSKIFNIQYLGGVRDNWGVTANGRIDTLNKVDGKFSHFAYMKPNNQSLSSVT

VTGQVTKGNKPGVNNPTVKVYKHIGSDDLAESVYAKLDDVSKFEDVTDNMSLDFDTNGGY

SLNFNNLDQSKNYVIKYEGYYDSNASNLEFQTHLFYYNYYYTSNLTWKNTGVAFYSNNAQ

GDGKDKLKEPIIEHSTPIELEFKSEPPVEKHELTGTIEESNDSKPIDFEYHTAVEGAEGH

AEGTIETEEDSIHVDFEESTHENSKHHADVVEYEEDTNPGGGQVTTESNLVEFDEDSTKG

IVTGAVSDHTTIEDTKEYTTESNLIELVDELPEEHGQAQGPIEEITENNHHISHSGLGTE

NGHGNYGVIEEIEENSHVDIKSELGYEGGQNSGNQSFEEDTEEDKPKYEQGGNIVDIDFD

SVPQIHGQNNGNQSFEEDTEKDKPKYEQGGNIIDIDFDSVPIHGFNKHTEIIEEDTNKD

KPNYQFGGHNSVDFEEDTLPQVSGHNEGQQTIEEDTTPPIVPPTPPTPEVPSEPETPTPP

TPEVPSEPETPTPPTPEVPTEPGKPIPPAKEEPKKPSKPVEQGKVVTPVIEINEKVKAVV

PTKKAQSKKSELPETGGEESTNNGMLPGGLFSILGLALLRRNKKNHKA

LOCUS 5 (L4)
>G0788_STAAU8325, UNDEFINED PRODUCT 779770:781077 FORWARD
MW: 50070
DQQKAFYQVLH

LKGITEEQRNQYIKTLREHPERAQEVFSESLKDSKNPDRRVAQQNAFYNVLKNDNLTEQE

KNNYIAQIKENPDRSQQVWVESVQSSKAKERQNIENADKAIKDFQDNKAPHDKSAAYEAN

SKLPKDLRDKNNRFVEKVSIEKAIVRHDERVKSANDAISKLNEKDSIENRRLAQREVNKA

PMDVKEHLQKQLDALVAQKDAEKKVAPKVEAPQIQSPQIEKPKVESPKVEVPQIQSPKVE

VPQSKLLGYYQSLKDSFNYGYKYLTDTYKSYKEKYDTAKYYYNTYYKYKGAIDQTVLTVL

GSGSKSYIQPLKVDDKNGYLAKSYAQVRNYVTESINTGKVLYTFYQNPTLVKTAIKAQET

ASSIKNTLSNLLSFWK

>00790_STAAU8325, UNDEFINED PRODUCT 781580:782542 FORWARD
MW: 36381
MNLKTANRKKISMIKNKILTATLAVGLIAPLANPFIEISKAENKIEDIGQGAEIIKRTQD

ITSKRLAITQNIQFDFVKDKKYNKDATNVKMQGFISSRTTYSDLKKYPYIKRMIWPFQYN

ISLKTKDSNVDLINYLPKNKIDSADVSQKLGYNIGGNFQSAPSIGGSGSFNYSKTISYNQ

KNYVTEVESQNSKGVKWGVKANSFVTPNGQVSAYDQYLFAQDPTGPAARDYFVPDNQLPP

LIQSGFNPSFITTLSHERGKGDKSEFEITYGRNMDATYAYVTRHRLAVDRKHDAFKNRNV

TVKYEVNWKTHEVKIKSITPK

>00791_STAAU8325, UNDEFINED PRODUCT 783104:784057 FORWARD
MW: 35954
VKLMLKNKILTTTLSVSLLAPLANPLLENAKAANDTEDIGKGSDIEIIKRTEDKTSNKWG

VTQNIQFDFVKDKKYNKDALILKMQGFISSRTTYYNYKKTNHVKAMRWPFQYNIGLKTND

KYVSLINYLPKNKIESTNVSQTLGYNIGGNFQSAPSLGGNGSFNYSKSISYT

LOCUS 6 (D1)
>G0659_STAAU8325, UNDEFINED PRODUCT 644649:646835 REVERSE
MW: 79536
MSKFIEPSVEEIKLEKVYQDMGLSDQEYEKVCDILGRQPNFTETGIFSVMWSEHCSYKHS

KPFLKQFPTSGDHVLMGPGEGAGVVDIGDNQAVVFKVESHNHPSAIEPYQGAATGVGGII

RDIVSIGARPINLLNSLRFGELDNKQNQRLLKGVVKGIGGYGNCIGIPTTAGEIEFDERY

DGNPLVNAMCVGVINHDMIQKGTAKGVGNSVIYVGLKTGRDGIHGATFASEELTEESESK

RPSVQIGDPFVGKKLMEATLEAITFDELVGIQDMGAAGLTSSSSEMAAKGGSGLHLRLEQ

TABLE 7-continued

VPTREPGISPYEMMLSETQERMLLVVEKGTEQKFLDLFDKHELDSAVIGEVTDTNRFVLT

YDDEVYADIPVEPLADEAPVYILEGEEKDYNTSKNDYTHIDVKDTFFKLLKHPTIASKHY

LY

LOCUS 7 (D1)
>G2308_STAAU8325, UNDEFINED PRODUCT 2206377:2207831 REVERSE
MW: 54671
MTDIINKLQAFADANPQSIAVRHTTDELTYQQLMDESSKLAHRLQGSKKPMILFGHMSPY

MIVGMIGAIKAGCGYVPVDTSIPEDRIKMIINKVQPEFVFNTTDESFESLEGEVFTIEDI

KTSQDPVIFDSQIKDNDTVYTIFTSGSTGEPKGVQIEYASLVQFTEWMLELNKSGNEQQW

LNQAPFSFDLSVMAIYPCLASGGTLNLVDKNMINKPKLLNEMLTATPINIWVSTPSFMEM

CLLLPTLNEEQYGSLNEFFFGCEILPHRAAKALVNRFPSATIYNTYGPTEATVAVTSIQI

TQEILDQYPTLPVGVERPGARLSTTDEGELVIEGQSVSLGYLKNDQKTAEVFNFDDGIRT

YHTGDKAKFENGQWFIQGRIDFQIKLNGYRMELEEIETQLRQSEFVKEAIVVPVYKNDKV

IHLIGAIVPTTEVTDNAEMTKNIKNDLKSRLPEYMIPRKFEWMEQLPLTSNGKIDRKKIA

EVING

>G2309_STAAU8325, UNDEFINED PRODUCT 2207850:2208050 REVERSE
MW: 7893
MNGLYKGVFTKNFKRCNMKSKSKQPPNKYVEAFKPYLLTLLYLAIFITLYLIYGSDTHN

NFIYNEF

>G2310_STAAU8325, UNDEFINED PRODUCT 2208050:2208157 REVERSE
MW: 4396
MMTTNYYVESIKLKLNFIMNIDIMNCKKQILKRILY

LOCUS 8 (D4)
>G1191_STAAU8325, UNDEFINED PRODUCT 1158690:1159313 FORWARD
MW: 24008
DPNIHQAVVQDDNPDFESGEITQELQKGYKLKDRVLRPSMYKYNQ

>G1192_STAAU8325, UNDEFINED PRODUCT 1159361:1161214 FORWARD
MW: 67451
MIKWRNFIMSKIIGIDLGTTNSCVTVLEGDEPKVIQNPEGSRTTPSVVAFKNGETQVGEV

AKRQAITNPNTVQSIKRHMGTDYKVDIEGKSYTPQEISAMILQNLKNTAESYLGEKVDKA

VITVPAYFNDAERQATKDAGKIAGLEVERIINEPTAAALAYGLDKTDKDEKVLVFDLGGG

TFDVSILELGDGVFEVLSTAGDNKLGGDDFDQVIIDYLVAEFKKENGVDLSQDKMALQRL

KDAAEKAKKDLSGVSQTQISKPFISAGENGPLHLEVNLTRSKFEELSKSLIRRTMEPTRQ

AMKDAGLTNSDIDEVILVGGS

LOCUS 9A (D22) AA SEQUENCE
>G0560_STAAU8325, UNDEFINED PRODUCT 529664:558268 FORWARD
MW: 1029886
DQNTIKQGVN

FTDADEAKRNAYTNAVTQAEQILNKAQGPNTSKDGVETALENVQRAKNELNGNQNVANAK

TTAKNALNNLTSINNAQKEALKSQIEGATTVAGVNQVSTTASELNTAMSNLQNGINDEAA

TKAALNGTQNLEKAKQHANTAIDGLSHLTNAQKEALKQLVQQSTTVAEAQGNEQKANNVD

AAMDKLRQSIADNATTKQNQNYTDASQNKKDAYNNAVTTAQGIIDQTTSPTLDPTVINQA

AGQVSTTKNALNGNENLEAAKQQASQSLGSLDNLNNAQKQTVTDQINGAHTVDEANQIKQ

NAQNLNTAMGNLKQAIADKDATKATVNFTDADQAKQQAYNTAVTNAENIISKANGGNATQ

AEVEQAIKQVNAAKQALNGNANVQHAKDEATALINSSNDLNQAQKDALKQQVQNATTVAG

VNNVKQTAQELNNAMTQLKQGIADKEQTKADGNFVNADPDKQNAYNQAVAKAEALISATP

DVVVTPSEITAALNKVTQAKNDLNGNTNLATAKQNVQHAIDQLPNLNQAQRDEYSKQITQ

TABLE 7-continued

```
ATLVPNVNAIQQAATTLNDAMTQLKQGIANKAQIKGSENYHDADTDKQTAYDNAVTKAEE

LLKQTTNPTMDPNTIQQALTKVNDTNQALNGNQKLADAKQDAKTTLGTLDHLNDAQKQAL

TTQVEQAPDIATVNNVKQNAQNLNNAMTNLNNALQDKTETLNSINFTDADQAKKDAYTNA

VSHAEGILSKANGSNASQTEVEQAMQRVNEAKQALNGNDNVQRAKDAAKQVITNANDLNQ

AMTQLKQGIADKDQTKANGNFVNADTDKQNAYNNAVAHAEQIISGTPNANVDPQQVAQAL

QQVNQAKGDLNGNHNLQVAKDNANTAIDQLPNLNQPQKTALKDQVSHAELVTGVNAIKQN

ADALNNAMGTLKQQIQANSQVPQSVDFTQADQDKQQAYNNAANQAQQIANGIPTPVLTPD

TVTQAVTTMNQAKDALNGDEKLAQAKQEALANLDTLRDLNQPQRDALRNQINQAQALATV

EQTKQNAQNVNTAMSNLKQGIANKDTVKASENYHDADADKQTAYTNAVSQAEGIINQTTN

PTLNPDEITRALTQVTDAKNGLNGEAKLATEKQNAKDAVSGMTHLNDAQKQALKGQIDQS

PEIATVNQVKQTATSLDQAMDQLSQAINDKAQTLADGNYLNADPDKQNAYKQAVAKAEAL

NLKQSGTNEVQAQVESITNEVNAAKQALNGNDNLANAKQQAKQQLANLTHLNDAQKQSFE

SQITQAPLVTDVTTINQKAQ
```

LOCUS 9B (I2) AA SEQUENCE
>G0558_STAAU8325, UNDEFINED PRODUCT 527809:529263 FORWARD
MW: 51904
```
SFSLFIVLEKRATNPLIDFKLFKNKAYTGATASNFL

LNGVAGTLIVANTFVQRGLGYSSLQAGSLSITYLVMVLIMIRVGEKLLQTLGCKKPMLIG

TGVLIVGECLISLTFLPEIFYVICCIIGYLFFGLGLGIYATPSTDTAIANAPLEKVGVAA

GIYKMASALGGAFGVALSGAVYAIVSNMTNIYTGAMIALWLNAGMGILSFVIILLLVPKQ

NDTQL
```

>G0560_STAAU8325, UNDEFINED PRODUCT 529664:558268 FORWARD
MW: 1029886
```
MNYRDKIQKFSIRKYTVGTFSTVIATLVFLGFNTSQAHAAETNQPASVVKQKQQSNNEQT

ENRESQVQNSQNSQNGQSLSATHENEQPNISQANLVDQKVAQSSTTNDEQPASQNVNTKK

DSATAATTQPDKEQSKHKQNESQSANKNGNDNRAAHVENHEANVVTASDSSDNGNVQHDR

NELQAFFDANYHDYRFIDRENADSGTFNYVKGIFDKINTLLGSND
```

LOCUS 9C (J13) AA SEQUENCE
```
DQEKRQAYDSKVTNAENIISGTPNATLTVNDV

NSAASQVNAAKTALNGDNNLRVAKEHANNTIDGLAQLNNAQKAKLKEQVQSATTLDGVQT

VKNSSQTLNTAMKGLRDSIANEATIKAGQNYTDASPNNRNEYDSAVTAAKAIINQTSNPT

MEPNTITQVTSQVTTKEQALNGARNLAQAKTTAKNNLNNLTSINNAQKDALTRSIDGATT

VAGVNQETAKATELNNAMHSLQNGINDETQTKQTQKYLDAEPSKKSAYDQAVNAAKAILT

KASGQNVDKAAVEQALQNVNSTKTALNGDAKLNEAKAAAKQTLGTLTHINNAQRTALDNE

ITQATNVEGVNTVKAKAQQLDGAMGQLETSIRDKDTTLQSQNYQDADDAKRTAYSQAVNA

AATILNKTAGGNTPKADVERAMQAVTQANTALNGIQNLDRAKQAANTAITNASDLNTKQK

EALKAQVTSAGRVSAANGVEHTATELNTAMTALKRAIADKAETKASGNYVNADANKRQAY

DEKVTAAENIVSGTPTPTLTPADVTNAATQVTNAKTQLNGNHNLEVAKQNANTAIDGLTS

LNGPQKAKLKEQVGQATTLPNVQTVRDNAQTLNTAMKGLRDSIANEATIKAGQNYTDASQ

NKQTDYNSAVTAAKAIIGQTTSPSMNAQEINQAKDQVTAKQQALNGQENLRTAQTNAKQH

LNGLSDLTDAQKDAVKRQIEGATHVNEVTQAQNNADALNTAMTNLKNGIQDQNTIKQGVN

FTDADE
```

TABLE 7-continued

LOCUS 9D (M11) AA SEQUENCE
>G0560_STAAU8325, UNDEFINED PRODUCT 529664:558268 FORWARD
MW: 1029886

SQAINDKAQTLADGNYLNADPDKQNAYKQAVAKAEAL

LNKQSGTNEVQAQVESITNEVNAAKQALNGNDNLANAKQQAKQQLANLTHLNDAQKQSFE

SQITQAPLVTDVTTINQKAQTLDHAMELLRNSVADNQTTLASEDYHDATAQRQNDYNQAV

TAANNIINQTTSPTMNPDDVNGATTQVNNTKVALDGDENLAAAKQQANNRLDQLDHLNNA

QKQQLQSQITQSSDIAAVNGHKQTAESLNTAMGNLINAIADHQAVEQRGNFINADTDKQT

AYNTAVNEAAAMINKQTGQNANQTEVEQAITKVQTTLQALNGDHNLQVAKTNATQAIDAL

TSLNDPQKTALKDQVTAATLVTAVHQIEQNANTLNQAMHGLRQSIQDNAATKANSKYINE

DQPEQQNYDQAVQAANNIINEQTATLDNNAINQAATTVNTTKAALHGDVKLQNDKDHAKQ

TVSQLAHLNNAQKHMEDTLIDSETTRTAVKQDLTEAQALDQLMDALQQSIADKDATRASS

AYVNAEPNKKQSYDEAVQNAESIIAGLNNPTINKGNVSSATQAVISSKNALDGVERLAQD

KQTAGNSLNHLDQLTPAQQQALENQINNATTRDKVAEIIAQAQALNEAMKALKESIKDQP

QTEASSKFINEDQAQKDAYTQAVQHAKDLINKTTDPTLAKSIIDQATQAVTDAKNNLHGD

QKLAQDKQRATETLNNLSNLNTPQRQALENQINNAATRGEVAQKLTEAQALNQAMEALRN

SIQDQQQTEAGSKFINEDKPQKDAYQAAVQNAKDLINQTNNPTLDKAQVEQTLQAVNQAK

DNLHGDQKLADDKQHAVTDLNQLNGLNNPQRQALESQINNAATRGEVAQKLAEAKALDQA

MQALRNSIQDQQQTESGSKFINEDKPQKDAYQAAVQNAKDLINQTGNPTLDKSQVEQLTQ

AVTTAKDNLHGDQKLARDQQQAVTTVNALPNLNHAQQQALTDAINAAPTRTEVAQHVQTA

TELDHAMETLKNKVDQVNTDKAQPNYTEASTDKKEAVDQALQAAESITDPTNGSNANKDA

VDQVLTKKLQEKENELNGNERVAEKTQAKQTIDQLTHLNADQIATAKQNI

LOCUS 9E (M13) AA SEQUENCE
>G0560_STAAU8325, UNDEFINED PRODUCT 529664:558268 FORWARD
MW: 1029886
DRVLASHPDVATIRQNVTAANAAKSALDQARNGLTVD

KAPLENAKNQLQHSIDTQTSTTGMTQDSINAYNAKLTAARNKIQQINQVLAGSPTVEQIN

TNTSTANQAKSDLDDHARQALTPDKAPLQTAKTQEQSINQPTDTTGMTTASLNAYNQKLQ

AARQKLTEINQVLNGNPTVQNINDKVTEANQAKDQLNTARQGLTLDRQPALTTLHGASNL

NQAQQNNFTQQINAAQNHAALETIKSNITALNTAMTKLKDSVADNNTIKSDQNYTDATPA

NKQAYDNAVNAAKGVIGETTNPTMDVNTVNQKAASVKSTKDALDGQQNLQRAKTEATNAI

THASDLNQAQKNALTQQVNSAQNVQAVNDIKQTTQSLNTAMTGLKRGVANHNQVVQSDNY

VNADTNKKNDYNNAYNHANDIINGNAQHPVITPSDVNNALSNVTSKEHALNGEAKLNAAK

QEANTALGHLNNLNNAQRQNLQSGINGAHQIDAVNTIKQNATNLNSAMGNLRQAVADKDQ

VKRTEDYADADTAKQNAYNSAVSSAETIINQTTNPTMSVDDVNRATSAVTSNKNALNGYE

KLAQSKTDAARAIDALPHLNNAQKADVKSKINAASNIAGVNTVKQQGTDLNTAMGNLQGA

INDEQTTLNSQNYQDATPSKKTAYTNAVQAAKDILNKSNGQNKTKDQVTEAMNQVNSAKN

NLDGTRLLD

LOCUS 10 (D9)
>G2169_STAAU8325, UNDEFINED PRODUCT 2045731:2047263 FORWARD
MW: 55179
MLMKSLFEAKAQQFGKSFMLPIAILPAAGLLGIGGALSNPNTVKAYPILDITLLQNIFTL

MSAAGSIVFQNLPVIFAIGVAIGLSRSDKGTAGLAALLGFLIMNATMNGLLTITGTLAK

TABLE 7-continued

```
>G2167_STAAU8325, UNDEFINED PRODUCT 2044443:2045375 REVERSE
MW: 33794
MKRKIIMDCDPGHDDAIALILAGAIDSPLEILAVTTVAGNQSVDKNTTNALNVLDIMGRQ

DIAVAKGADRPLIKPAAFASEIHGESGLDGPKLPSTPSRQAVAMPASDVIINKVMTSDTP

VTIVATGPLTNVATALIREPRIAEHIESITLMGGGTFGNWTPTEAFNIWVDAEAAKRVFE

SGITINVFGLDVTHQVLAD

LOCUS 11 (D10)
>G2285_STAAU8325, UNDEFINED PRODUCT 2183380:2183499 REVERSE
NW: 4917
MHQLKALLVLTHPRYYKTSQKHHYLIYLNKNSQSYLILFL

>G2286_STAAU8325, UNDEFINED PRODUCT 2183646:2184428 REVERSE
NW: 27575
MIFMTNNKVALVTGGAQGIGFKIAERLVEDGFKVAVVDFNEEGAKAAALKLSSDGTKAIA

IKADVSNRDDVFNAVRQTAAQFGDFHVMVNNAGLGPTTPIDTITEEQFKTVYGVNVAGVL

WGIQAAHEQFKKFNHGGKIINATSQAGVEGNPGLSLYCSTKFAVRGLTQVAAQDLASEGI

TVNAFAPGIVQTPMMESIAVATAEEAGKPEAWGWEQFTSQIALGRVSQPEDVSNVVSFLA

GKDSDYITGQTIIVDGGMRFR

>G2287_STAAU8325, UNDEFINED PRODUCT 2184634:2185257 REVERSE
NW: 22980
MEKNVEKSFIKIGLYFQIAYIVLMAITLCGFVICYGLIFGLFYLLSGSRADYLIVTIVIS

AIISIFVIILSIVPVIVLASDLFKERISKGVILIVLAIIALVLCNFVSAILWFVSAISIL

GRKKLVAAADTTTIQKSKGNANQASHKDTCKKELDSQDMMEHPEVKNPTTKNLEGFNEEI

HKDEATTKVVSDNTEPPIESKDHVSKKD

LOCUS 12 ()
>G1787_STAAU8325, UNDEFINED PRODUCT 1678934:1683439 REVERSE
NW: 166665
RGGVGADG

ITGDGAGIMTEIPFAFFKQHVTDFDIPGEGEYAVGLFFSKERILGSEHEVVFKKYFEGEG

LSILGYRNVPVNKDAIAKHVADTMPVIQQVFIDIRDIEDVEKRLFLARKQLEFYSTQCDL

ELYFTSLSRKTIVYKGWLRSDQIKKLYTDLSDDLYQSKLGLVHSRFSTNTFPSWKRAHPN

RMLMHNGEINTIKGNVNWMRAPQHKLIETLFGEDQHKVFQIVDEDGSDSAIVDNALEFLS

LAMEPEKAAMLLIPEPWLYNEANDANVRAFYEFYSYLMEPWDGPTMISFCNGDKLGALTD

RNGLRPGRYTITKDNFIVFSSEVGVVDVPESNVAFKGQLNPGKLLLVDFKQNKVIENNDL

KGAIAGELPYKAWIDNHKVDFDFENIQYQDSQWKDETLFKLQRQFAYTKEEIHKYIQELV

EGKKDPIGAMGYDAPIAVLNERPESLFNYFKQLFAQVTNPPIDAYREKIVTSELSYLGGE

GNLLAPDETVLDRIQLKRPVLNESHLAAIDQEHFKLTYLSTVYEGDLEDALEALGREAVN

AVKQGAQILVLDDSGLVDSNGFAMPMLLAISHVHQLLIKADLRMSTSLVAKSGETREVHH

VACLLAYGANAIVPYLAQRTVEQLTLTEGLQGTVVDNVKTYTDVLSEGVIKVMAKMGIST

VQSYQGAQIFEAIGLSHDVIDRYFTGTQSKLSGISIDQIDEANKARQQSDDNYLASGSTF

QWRQQGQHHAFNPESIFLLQHACKENDYAQFKAYSEAVNKNRTDHIRHLLEFKACTPIDI

DQVEPVSDIVKRFNTGAMSYGSISAEAHETLAQAMNQLGGKSNSGEGGEDAKRYEVQVDG

SNKVSAIKQVASGRFGVTSDYLQHAKEIQIKVAQGADPGEGGQLPGTKVYPWIAKTRGST

PGIGLISPPPHHDIYSIEDLAQLIHDLKNANKDADIAVKLVSKTGVGTIASGVAKAFADK

IVISGYDGGTGASPKTSIQHAGVPWEIGLAETHQTLKLNDLRSRVKLETDGKLLTGKDVA

YACALGAEEFGFATAPLVVLGCIMMRVCHKDTCPVGVATQNKDLRALYRGKAHHVVNFMH

FIAQELREILASLGLKRVEDLVGRTDLLQRSSTLKANSKAASIDVEKLLCPFDGPNTKEI
```

TABLE 7-continued

QQNHNLEHGFDLTNLYEVTKPYIAEGRRYTGSFTVNNEQRDVGVITGSEISKQYGEAGLP

ENTINVYTNGHAGQSLAAYAPKGLMIHHTGDANDYVGKGLSGGTVIVKAPFEERQNEIIA

GNVSFYGATSGKAFINGSAGERFCIRNSGVDVVVEGIGDHGLEYMTGGHVINLGDVGKNF

GQGMSGGIAYVIPSDVEAFVENNQLDTLSFTKIKHQEEKAFIKQMLEEHVSHTNSTRAIH

VLKHFDRIEDVVVKVIPKDYQLMMQKIHLHKSLHDNEDEAMLAAFYDDSKTIDAKHKPAV

VY

LOCUS 13 (D18)
>G1977_STAAU8325, UNDEFINED PRODUCT 1846179:1847864 REVERSE
MW: 62494
MRVIMEIILFLTMMVMITYVFSGYLYRVALVQSSRVDLIFTRFENMCFKIIGTDLEHMSA

KTYVKHFLAFNGFMGFITFVLLIVQQMLFLNPNHNLNQSIDLAFNTAISFLTNSNLQHYN

GESDVTYLTQMIVMTYLMFTSSASGYAVCIAMLRRLTGLTNIIGNFYQDIVRFIVRVLLP

LSCLISILLMTQGVPQTLHANLMIRTLSGHIQHIAFGPIASLESIKHLGTNGGGFLAGNS

ATPFENPNIWSNFIEMGSMMLLPMSMLFLFGRMLSRHGKRVHRHALILPVAMFFIFIAIL

TLTMWSEYRGNPILANLGIYGPNMEGKEVRFGAGLSALFTVITTAFTTGSVNNMHDSLTP

IGGLGPMVLMMLNVVFGGEGVGLMNLLIFVLLTVFICSLMVGKTPEYLNMPIGAREMKCI

VLVFLIHPILILVFSALAFMIPGASESITNPSFHGISQVMYEMTSAAANNGS

LOCUS 14 (D21)
>G2377_STAAU8325, UNDEFINED PRODUCT 2262585:2263772 REVERSE
MW: 42602
DPELGKYWASLGDVFVNDAFGTAHREHASNVGISTHLETAAGFLMDKEI

KFIGGVVNDPHKPVVAILGGAKVSDKINVIKNLVNIADKIIIGGGMAYTFLKAQGKEIGI

SLLEEDKIDFAKDLLEKHGDKIVLPVDTKVAKEFSNDAKITVVPSDSIPADQEGMDIGPN

TVKLFADELEGAHTVVWNGPMGVFEFSNFAQGTIGVCKAIANLKDAITIIGGGDSAAAAI

SLGFENDFTHISTGGGASLEYLEGKELPGIKAINNK

>G2375_STAAU8325, UNDEFINED PRODUCT 2261702:2262559 REVERSE
MW: 30982
MACLFNIVTGKQSQDDIVFHHFSKIFTKQGVSLMRTPIIAGNWKMNKTVQEAKDFVNTLP

TLPDSKEVESVICAPAIQLDALTTAVKEGKAQGLEIGAQNTYFEDNGAFTGETSPVALAD

LGVKYVVIGHSERRELFHETDEEINKKAHAIFKHGMTPIICVGETDEERESGKANDVVGE

QVKKAVAGLSEDQLKSVVIAYEPIWAIGTGKSSTSEDANEMCAFVRQTIADLSSKEVSEA

TRIQYGGSVKPNNIKEYMAQTDIDGALVGGASLKVEDFVQLLEGAK

>G2374_STAAU8325, UNDEFINED PRODUCT 2260182:2261696 REVERSE
MW: 56424
MAKKPTALIILDGFANRESEHGNAVKLANKPNFDRYYNKYPTTQIEASGLDVGLPEGQMG

NSEVGHMNIGAGRIVYQSLTRINKSIEDGDFFENDVLNNAIAHVNSHDSALHIFGLLSDG

GVHSHYKHLFALLELAKKQGVEKVYVHAFLDGRDVDQKSALKYIEETEAKFNELGIGQFA

SVSGRYYAMDRDKRWEREEKAYNAIRNFDAPTYATAKEGVEASYNEGLTDEFVVPFIVEN

QNDGVNDGDAVI

LOCUS 15 (I1)
>G2097_STAAU8325, UNDEFINED PRODUCT 1973418:1974263 REVERSE
MW: 31442
VDLNDRLTFHKRKDRKIVVEIENNYVP

SNHKNLAYRAAQLFIEQYQLKQGVTISIDKEIPVSAGLAGGSADAAATLRGLNRLFDIGA

SLEELALLGSKIGTDIPFCIYNKTALCTGRGEKIEFLNKPPSAWVILAKPNLGISSPDIF

TABLE 7-continued

KLINLDKRYDVHTKMCYEALENRDYQQLCQSLSNRLEPISVSKHPQIDKLKNNMLKSGAD

GALMSGSGPTVYGLARKESQAKNIYNAVNGCCNEVYLVRLLG

>G2096_STAAU8325, UNDEFINED PRODUCT 1972580:1973401 REVERSE
MW: 30395
MRYKRESRIVFMTQYLMNHPNKLIPLTFFVKKFKQAKSSISEDVQIIKNTFQKEKLGTVI

TTAGASGGVTYKPMMSKEEATEVVNEVITLLEEKERLLPGGYLFLSDLVGNPSLLNKVGK

LIASIYMEEKLDAVVTIATKGISLANAVANILNLPVVVIRKDNKVTEGSTVSINYVSGS

LOCUS 17 (I3)
>G1894_STAAU8325, UNDEFINED PRODUCT 1776805:1778031 REVERSE
MW: 45559
DRTALEEQEATFGRKRHSGAPLTGGKEF

DEIDLKAKDSHGEYIIDKDAHTRLAKEANTSILRRAFNYVDGTDDRTGNFETGLLFIAFQ

KATKQFIDIQNNLGSNDKLNEYITHRGSASFLVLPGVSKGGYLGETLFD

>G1893_STAAU8325, UNDEFINED PRODUCT 1775112:1776845 REVERSE
MW: 64202
MLVREDTLVKHYLTKFVAMLITAAMVCSFGLLKSQAAEQQSISDVYSVITDAKSALSNNS

ISNDNKQKAIEQVVSAVKKLSEDNSESNAVKSDVRKLEDAKANDNQKDTLSQLTKSLIA

YEEKLASKDAGSKIKLLQQQVDAKDAAMTKAIKDKNKAELESLNNSLNQTWTSNETVIRN

YDANQYGQTIVALLQLRIAIHKSPLDTAKVSHAWTTFKSNIDHVDKKSNTSANDQYHVSQ

LNDALEKAIKAIDDNQLSDADAALTHFIETWPYVEGQIQTKDGALYTKIEDKIPYYQSVL

DEHNKAHVKDGLVDLNNQIKEVVGHSYSFVDVMIIFLREGLEVLLIVMTLTTMTRNVKDK

KGTASVIGGAIAGLVLSIILAITFVETLGNSGILRESMEAGLGIVAVILMFIVGVWMHKR

SNAKRWNDMIKNMYANAISNGNLVLLATIGLISVLREGVEVIIFYMGMIGELATKDFIIG

IALAIVILIIFALLFRFIVKLIPIFYIFRVLSI

LOCUS 18 (I5)
>G2386_STAAU8325, UNDEFINED PRODUCT 2274220:2275152 REVERSE
MW: 33616
MTEIDFDIAIIGAGPAGMTAAVYASRANLKTVMIERGIPGGQMANTEEVENFPGFEMITG

PDLSTKMFEHAKKFGAVYQYGDIKSVEDKGEYKVINFGNKELTAKAVIIATGAEYKKIGV

PGEQELGGRGVSYCAVCDGAFFKNKRLFVIGGGDSAVEEGTFLTKFADKVTIVHRRDELR

AQRILQDRAFKNDKIDFIWSHTLKSINEKDGKVGSVLTTSTKDGSEETHEADGVFIYIGM

KPLTAPFKDLGITNDVGYIVTKDDMTTSVPGIFAAGDVRDKGLRQIVTATGDGSIAAQSA

AEYIEHLND

>G2387_STAAU8325, UNDEFINED PRODUCT 2275222:2276658 REVERSE
MW: 57062
HYRLYGIFLLDQLNGKEIVM

TESIWQVLENLNNYEKLYLTYLVQGLTLNKLDFIHRGLLTLYHNELFVSENDVMVAWINQ

GELIIAEKVDLTDVEPYIGAFIYLYFKNQPRNVTKKQITTWLGITQYKLNKMIEFLLSI

LOCUS 19 (I8)
>G2296_STAAU8325, UNDEFINED PRODUCT 2195143:2196150 REVERSE
MW: 37749
DDEIILLNPMGMAIEDISSAYFIYQQAQQQNIGTTLNLY

G2295_STAAU8325, UNDEFINED PRODUCT 2193368:2195119 REVERSE
MW: 66415
MQNHTAVNTAQAIILRDLVDALLFEDIAGIVSNSEITKENGQTLLIYERETQQIKIPVYF

SALNMFRYESSQPITIEGRVSKQPLTAAEFWQTIANMNCDLSHEWEVARVEEGLTTAATQ

LAKQLSELDLASHPFVMSEQFASLKDRPFHPLAKEKRGLREADYQVYQAELNQSFPLMVA

AVKKTHMIHGDTANIDELENLTVPIKEQATDMLNDQGLSIDDYVLFPVHPWQYQHILPNV

TABLE 7-continued

```
FAKEISEKLVVLLPLKFGDYLSSSSMRSLIDIGAPYNHVKVPFAMQSLGALRLTPTRYMK

NGEQAEQLLRQLIEKDEALAKYVMVCDETAWNSYMGQDNDIFKDQIGHLTVQLRKYPEVL

AKNDTQQLVSMAALAANDRTLYQMICGKDNISKNDVMTLFEDIAQVFLKVTLSFMQYGAL

PELHGQNILLSFEDGRVQKCVLRDHDTVRIYKPWLTAHQLSLPKYVVREDTPNTLINEDL

ETFFAYFQTLAVSVNLYAIIDAIQDLFGVSEHELMSLLKQILKNEVATISWVTTDQLAVR

HILFDKQTWPFKQILLPLLYQRDSGGGSMPSGLTTVPNPMVTYD

>G2294_STAAU8325, UNDEFINED PRODUCT 2192119:2193372 REVERSE
MW: 44835
MINQSIWRSNFRILWLSQFIAIAGLTVLVPLLPIYMASLQNLSVVEIQLWSGIAIAAPAV

TTMIASPIWGKLGDKISRKWMVLRALLGLAVCLFLMALCTTPLQFVLVRLLQGLFGGVVD

ASSAFASAEAPAEDRGKVLGRLQSSVSAGSLVGPLIGGVTASILGFSALLMSIAVITFIV

CIFGALKLIETTHMPKSQTPNINKGIRRSFQCLLCTQQTCRFIIVGVLANFAMYGMLTAL

SPLASSVNHTAIDDRSVIGFLQSAFWTASILSAPLWGRFNDKSYVKSVYIFATIACGCSA

ILQGLATNIEFLMAARILQGLTYSALIQSVMFVVVNACHQQLKGTFVGTTNSMLVVGQII

GSLSGAAITSYTTPATTFIVMGVVFAVSSLFLICSTITNQIND

LOCUS 20 (J7/M10)
>G2187_STAAU8325, UNDEFINED PRODUCT 2068723:2070984 REVERSE
MW: 85428
LPDNFKTYCAKMSIKTSSIQYENDDIMRESYGDDYGIACCV

SAMTIGKQMQFFGARANLAKTLLYAINGGKDEKSGAQVGPNFEGINSEVLEYDEVFKKFD

QMMDWLAGVYINSLNVIHYMHDKYSYERIEMALHDTEIVRTMATGIAGLSVAADSLSAIK

YAQVKPIRNEEGLVVDFEIEGDFPKYGNNDDRVDDIAVDLVERFMTKLRSHKTYRDSEHT

MSVLTITSNVVYGKKTGNTPDGRKAGEPFAPGANPMHGRDQKGALSSLSSVAKIPYDCCK

DGISNTFSIVPKSLGKEPEDQNRNLTSMLDGYAMQCGHHLNINVFNRETLIDAMEHPEEY

PQLTIRVSGYAVNFIKLTREQQLDVISRTFHESM

>G2186_STAAU8325, UNDEFINED PRODUCT 2067945:2068697 REVERSE
MW: 28498
MLKGHLHSVESLGTVDGPGLRYILFTQGCLLRCLYCHNPDTWKISEPSREVTVDEMVNEI

LPYKPYFDASGGGVTVSGGEPLLQMPFLEKLFAELKENGVHTCLDTSAGCANDTKAFQRH

FEELQKHTDLILLDIKHIDNDKHIRLTGKPNTHILNFARKLSDMKQPVWIRHVLVPGYSD

DKDDLIKLGEFINSLDNVEKFEILPYHQLGVHKWKTLGIAYELEDVEAPDDEAVKAAYRY

VNFKGKIPVEL

>G2185_STAAU8325, UNDEFINED PRODUCT 2065846:2067657 REVERSE
MW: 69718
MKNIKMKLNIKAMRSVIMKRISKDIWAVFKLLYQNKGRFSINALLLQLIMIFISSTYLIL

LFNMMLKVAGQSQLTINNWTEIVSHPASVILLIIFILSVAFLIYVEFSLLVYMVYAGFDR

QIITFKSIFKNAFVNVRKLIGVPVIFFVIYLMLMIPIANLGLSSVLTKNIYIPKFLTEEL

MKTTKGIIIYGTFMIAVFILNFKLIFTLPLTILNRQSLFKNMRLSWQITKRNKFRLVIEI

VILELIIGAILTLIISGATYLAICVDEEGDKFLVSSILFVVLKSALFFYYLFTKLSLISV

LVLHLKQENVLDQPGLEFKYPKPKRKSRFFIISMVLAVTCFIGYNMYLLYNNTINTNISI

IGHRGFEDKGVENSIPSLKAAAKANVEYVELDTIMTKDKQFVVSHDNNLKRLTGVNKNIS

ESNFKDIVGLKMRQNGHEAKFVSLDEFIETAKQSNVKLLVELKPHGKEPADYTQRVIDIL

KKHGVEHQYRVMSLDYDVMTKLKKEAPYLKCGYIIPLQFGHFKETSLDFFVIEDFSYSPR
```

TABLE 7-continued

LVNHQAHLENKEVYTWTINGEEDLTKYQTNVDGIITDDPALADQIKEEKKDETYFDRSIR

ILFE

>G2184_STAAU8325, UNDEFINED PRODUCT 2065335:2065676 FORWARD
MW: 12828
MTTQMKIKTYLVAGIKAALLDTTGIKLASKSETTSHTYQHQALVDQLHELIANTDLNKLS

YLNLDAFQKRDILAAHYIAKSAIRTKNLDQMTKAKQRLESIYNSISNPLHSQNN

>G2183_STAAUB325, UNDEFINED PRODUCT 2063238:2065145 REVERSE
MW: 71718
MKKQIISLGALAVASSLFTWDNKADAIVTKDYSGKSQVNAGSKNGTLIDSRYLNSALYYL

EDYIIYAIGLTNKYEYGDNIYKEAKDRLLEKVLREDQYLLERKKSQYEDYKQWYANYKKE

NPRTDLKMANFHKYNLEELSMKEYNELQDALKRALDDFHREVKDIKDKNSDLKTFNAASE

DKATKEVYDLVSEIDTLVVSYYGDKDYGEHAKELRAKLDLILGDTDNPHKITNERIKKEM

IDDLNSIIDDFFMETKQNRPKSITKYNPTTHNYKTNSDNKPNFDKLVEETKKAVKEADDS

WKKKTVKKYGETETKSPVVKEEKKVEEPQAPKVDNQQEVKTTAGKAEETTQPVAQPLVKI

PQGTITGEIVKGPEYPTMENKTVQGEIVQGPDFLTMEQSGPSLSNNYTNPPLTNPILEGL

EGSSSKLEIKPQGTESTLKGTQGESSDIEVKPQATETTEASQYGPRPQFNKTPKYVKYRD

AGTGIREYNDGTFGYEARPRFNKPSETNAYNVTTHANGQVSYGARPTYKKPSETNAYNVT

THANGQVSYGARPTQNKPSKTNAYNVTTHGNGQVSYGARPTQNKPSKTNAYNVTTHANGQ

VSYGARPTYKKPSKTNAYNVTTHADGTATYGPRVTK

>G2182_STAAU8325, UNDEFINED PRODUCT 2062946:2063050 FORWARD
MW: 3842
MCVRTRLVSSSSARLSKAIIIAVIVVYHLDVRGLF

>G2181_STAAU8325, UNDEFINED PRODUCT 2061438:2062628 FORWARD
MW: 42182
MITMQEAYIVAYGRSAAAKAKQGALFHERPDDVAAKVLQGVLKRIDGKFNKNMIEDVIVG

TAFPEGLQGQNIARTIALRAGLSDTVPGQTVNRYCSSGLQTIAIAANQIMAGQGDILVAG

GVELMSAVPMGGNEPTNNPTLQYDDIGASYPMGLTAENVASQFDVSREDQDAYAVRSHQR

AYDAQRDGRFKDEIIPIQVNSVEYTNAGPKVHTNIFDQDEFIRPDTTMEALAKLRTVFKA

DGTMTAGTSAPLSDGAGFVVLMSGDKVKELGVTPIARFVGFKAVGVDPKIMGIGPAYAIP

EVLSLSNLSVEDIDLIELNEAFASQTIASIKEVGLDISRTNVNGGAIALGHPLGATGAML

TARLLNEMGRRPDSRYGMVTMCIGVGMGAAAIFEYVR

>G2180_STAAU8325, UNDEFINED PRODUCT 2059156:2061414 FORWARD
MW: 84609
MTINKVTVLGAGTMGAQLAALFVNAGLKVKLLDIVVDKNDPNLIAKKSYDKITDKKRPLL

FDLNLASHLTYGNFDDDLVNDDADLYIEAVKEDIEIKHAVWQQVLQHAKEDALFATNTSG

IPINAIAQAFNEKDQERFFGLHFFNPPRIMKLVELIPTSHTKESIILDVKNFAQNVLGKG

VIVVVNDVPGFVANRVGTQTMNDIMYRAEQHKISIVDVDALTGQAIGRPKTGTYALSDLVG

LDIAVSVIKGMQQVPEETPYFHDVKIVNTLFDNGALGRKTKQGFYKKDKETKARLVYDVE

KQDYVPVSQPQLPILNEFNKDLVHNLDTIFNAQDEAGLFLWETLRNNFYYSAINVPKATD

DFRDIDRALVWGFNWKLGPFQLWDAMGYERVKTRMEDELGDLPQWISDLDGGFYKQDETI

EYATPISHFVKDELWDKGDAKLSVTHDDQLLIKLQSKNNVITDEFNDALVDAIDLLENDH

YTSMVIYADGNNFSVGANLFLMKKAHEDGLVDDVVAQSIDKLHYSFNRLKYSLKPVVTAV

QGRALGGGCELVLYSPIVVAASETYIGLVEAGVGLIPSGGGLAEMADRILRTSHKFDDKQ

ASMTKVLTNIAFAKVSTNAFEARRYGYLRDTDTIIFNTAQRVEVALKRAKYEAETNYIPN

TABLE 7-continued

PRHQYIALGEDFKALIQGQLDAQRRGHFISDHDYHIALNIATILAGGDLPRNTFINQRYI

QSLEKIFGIDLLKSKKSYERIAHMLKTGKPLRN

>G2179_STAAU8325, UNDEFINED PRODUCT 2057714:2058967 FORWARD
MW: 46482
MHFTLVFILFLGGIYMTFEKETVLKTLFPEDVLSIAKGLTDGEVEFLQQVDSLLESKYRE

NINQHWIDATVPEDYFKDLGELNYFNNPLLYKDRPNAKMPSQLFQFFMSYLLARFDISLA

TLLGVHQGLGHNTFYFGGSKEQIAKYVPKLQSHELRTCFALTEPEHGSDVAGGLETVAER

QGDTWVINGEKKWIGGAHVSDVIPVFAVNKETGKPHCFVVRPEGDGVDIEVIDNKIALRI

VRNALIKLTNVKVDEADRLQNITSFKDIAKILYSTRAGVAYMATGGMAGALRATLDYVTE

RKQFGKPISKYQLIQEKLAMMQGNLAQAMATCAQLANMQAHGEYDEVATSTAKMMNALRL

RETVAMGRGITGGNGILADDYDIARFFSDAEAIYTYEGTHEINALVIGRALTGDSAFV

LOCUS 21 (G3)
G1927FRG
MNILFAITGIAFALFVAFLF

>G1928_STAAU8325, UNDEFINED PRODUCT 1810990:1811910 REVERSE
MW: 32866
MANLQKYIEYSREVQQARENNQPIVALESTIISHGMPYPQNVEMATTVEQIIRNNGAIPA

TIAIIDGKIKIGLESEDLEILATSKDVAKVSRRDLAEVIAMKCVGATTVATTMICAAMAG

IQFFVTGGIGGVHKGAEHTMDISADLEELSKTNVTVICAGAKSILDLPKTMEYLETKGVP

VIGYQTNELPAFFTRESGVKLTSSVETPERLADIHLTKQQLNLEGGIVVANPIPYEHALS

KAYIEAIINEAVVEAENQGIKGKDATPFLLGKIVEKTNGKSLAANIKLVENNAALGAKIA

VAVNKLL

G1929
LDHVQQFENASTGSYTALISKEGDMTYGLADMEVFDYITPE

FLIKRSHLLKKAKCIIVDLNLGKEALNFLCAYTTKHQIKLVITTVSSPKMKNMPDSLHAI

DWIITNKDETETYLNLKIESTDDLKIAAKRWNDLGVKNVIVTNGVKELIYRSGEEEIIKS

VMPSNSVKDVTGAGDSFCAAVVYSWLNGMSTEDILIAGMVNAKKTIETKYTVRQNLDQQQ

LYHDMEDYKNGKFTKVY

LOCUS 22 (I19)
>G0974 FRG_STAAU8325, UNDEFINED PRODUCT 974673:975977 REVERSE
MW: 47346
VNEMVNEQIIDISGPLKGEIEVPGDKSMTHRAIMLASLAEGVSTIYKPLLGEDCRRTMDI

FRLLGVEIKEDDEKLVVTSPGYQSFNTPHQVLYTGNSGTTTRLLAGLLSGLGIESVLSGD

VSIGKRPMD

>G0975_STAAU8325, UNDEFINED PRODUCT 975981:977042 REVERSE
MW: 40300
MKLQTTYPSNNYPIYVEHGAIDHISTYIDQFDQSFILIDEHVNQYFADKFDDILSYENVH

KVIIPAGEKTKTFEQYQETLEYILSHHVTRNTAIIAVGGGATGDFAGFIAATLLRGVHFI

QVPTTILAHDSSVGGKVGINSKQGKNLIGAFYRPTAVIYDLVFLKTLPFEQILSGYAEVY

KHALLNGESATQDIEQHFKDREILQSLNGMDKYIAKGIETKLDIVIADEKEQGVRKFLNL

GHTFGHAVEYYHKIPHGHAVMYGIIYQFIVANALFDSKHDINHYIQYLIQLGYPLDMITD

LDFETLYQYMLSDKKNDKQGVQMVLIRQFGDIVVQHVDQLTLQHACEQLKTYFK

>G0976 FRG_STAAU8325, UNDEFINED PRODUCT 977071:978240 REVERSE
MW: 43249
DFYDSETFKANLDRNDVRVIDDSIAQAMRDKIDEAKNEGDSIGGVVQVVVENMPVGVGSYVH

YDRK

TABLE 7-continued

```
LDGKIAQGVVSINAFKGVSFGEGFKAAEKPGSEIQDEILYNSEIGYYRGSNHLGGLEGGMSN

GMPIIVNGVMKPIPTLYKPLNSVDINTKEDFKATIERSDSCAVPAASIVCEHVVAFEIAKAL

LEEFQSNHIEQLKQQIIERRQLNIEF

LOCUS 24:
G0243FRG
DRPIQVGSHFHFYEANAALDFEREMAYGKHLDIPAGAAVRFEPGDKKEVQLVEYAGKRKIFG

FRGMVNGPIDESRVYRPTDENDEYAGVFGDNGAENVNKKGGKRS

>G0244_STAAU8325, UNDEFINED PRODUCT 218549:220261 FORWARD
MW: 61780
MSFKMTQNQYTSLYGPTVGDSIRLGDTNLFAQIEKDYAVYGEEATFGGGKSIRDGMAQNP

RVTRDDVNVADLVISNAVIIDYDKVVKADIGIKNGYIFAIGNAGNPDIMDNVDIIIGSTT

DIIAAEGKIVTAGGIDTHVHFINPEQAEVALESGITTHIGGGTGASEGSKATTVTPGPWH

IHRMLEAAEGLPINVGFTGKGQATNPTALIEQINAGAIGLKVHEDWGATPSALSHALDVA

DEFDVQIALHADTLNEAGFMEDTMAAVKDRVLHMYHTEGAGGGHAPDLIKSAAFSNILPS

STNPTLPYTHNTVDEHLDMVMITHHLNAAIPEDIAFADSRIRKETIAAEDVLQDMGVFSM

ISSDSQAMGRVGEVITRTWQVAHRMKEQRGPLDGDFEGNDNNRIKRYIAKYTINPAITHG

ISEYVGSIEPG

>LOCUS 25:
G0027_STAAU8325, UNDEFINED PRODUCT 32103:32513 REVERSE
MW: 16524
MNEYRNKKGPDYSIFKNNWKVLLMDTSKTIFSKYRWNKSFKAYKRSSDIVEFMLSKDDIL

RHSYELVQGLRKDLRLCNWPKFINRLNSVSKKSVSKGVWKVVKYYRKHQRMLRNTIYYPA

FNNGAIEGINNKIKLIK

LOCUS 26:
>G2458FRG_STAAU8325, UNDEFINED PRODUCT 2348221:2350185 REVERSE
MW: 69055
VKIMRVTELLTKDTIAMDLMANDKNGVIDELVNQLDKAGKLSDVASFKEAIHNRESQSTT

GIGEGIAIPHAKVAAVKSPAIAFGKSKAGVDYQSLDMQPAHLFFMIAAPEGGAQTHLDAL

AKLSGILMDENVREKLLHASSPEEVLAI

>G2459_STAAU8325, UNDEFINED PRODUCT 2350185:2351102 REVERSE
MW: 32573
MIYTVTFNPSIDYVIFTNDFKIDGLNRATATYKFAGGKGINVSRVLKTLDVESTALGFAG

GFPGKFIIDTLNNSAIQSNFIEVDEDTRINVKLKTGQETEINAPGPHITSTQFEQLLQQI

KNTTSEDIVIVAGSVPSSIPSDAYAQIAQITAQTGAKLVVDAEKELAESVLPYHPLFIKP

NKDELEVMENTTVNSDTDVIKYGRLLVDKGAQSVIVSLGGDGAIYIDKEISIKAVNPQGK

VVNTVGSGDSTVAGMVAGIASGLTIEKAFQQAVACGTATAFDEDLATRDAIEKIKSQVTI

SVLDGE

G2460FRG
DRTGCSASTIRRDLSKLQQLGKLQRVHGGAM

LKENRMVEANLTEKLATNLDEKKMIAKIAANQINDNECLFIDAGSSTLELIKYIQAKDII

VVTNGLTHVEALLKKGIKTIMLGGQVKENTLATIGSSAMEILRRYCFDKAFIGMNGLDIE

LGLTTPDEQEALVKQTAMSLANQSFVLIDHSKFNKVYFARVPLLESTTIITSEKALNQES

LKEYQQKYHFIGGTL

LOCUS 27:
G1326FRG
GSPVLNSKHELIGILYAGSGKDESEKNFGVYFTPQLKEFIQNNIEK
```

TABLE 7-continued

```
>G1327_STAAU8325, UNDEFINED PRODUCT 1284689:1285450 FORWARD
MW: 27870
MYLDIKIIKREELKMNKNVVIKSLAALTILTSVTGIGTTLVEEVQQTAKAENNVTKVKDT

NIFPYTGVVAFKSATGFVVGKNTILTNKHVSKNYKVGDRITAHPNSDKGNGGIYSIKKII

NYPGKEDVSVIQVEERAIERGPKGFNFNDNVTPFKYAACAKAGERIKVIGYPHPYKNKYV

LYESTGPVMSVEGSSIVYSAHTESGNSGSPVLNSNNELVGIHFASDVKNDDNRNAYGVYF

TPEIKKFIAENIDK

>G1329_STAAU8325, UNDEFINED PRODUCT 1285505:1286227 FORWARD
MW: 26340
LKMNKNIVIKSMAALAILTSVTGINAAVVEETQQIANAEKNVTQVKDTNIFPYNGVVSFK

DATGFVIGKNTIITNKHVSKDYKVGDRITAHPNGDKGNGGIYKIKSISDYPGDEDISVMN

IEEQAVERGPKGFNFNENVQAFNFAKDAKVDDKIKVIGYPLPAQNSFKQFESTGTIKRIK

DNILNFDAYIEPGNSGSPVLNSNNEVIGVVYGGIGKIGSEYNGAVYFTPQIKDFIQKHIE

Q

>G1330_STAAU8325, UNDEFINED PRODUCT 1286327:1287067 FORWARD
MW: 26652
MNKQRSTKMNKNIIIKSIAALTILTSITGVGTTVVDGIQQTAKAENSVKLITNINVAPYS

GVTWMGAGTGFVVGNHTIITNKHVTYHMKVGDEIKAHPNGFYNNGGGLYKVTKIVDYPGK

EDIAVVQVEEKSTQPKGRKFKDFTSKFNIASEAKENEPISVIGYPNPNGNKLQMYESTGK

VLSVNGNIVTSDAVVQPGSSGSPILNSKREAIGVMYASDKPTGESTRSFAVYFSPEIKKF

IADNLDK

>G1332_STAAU8325, UNDEFINED PRODUCT 1287228:1287941 FORWARD
MW: 25679
MNKNIIIKSIAALTILTSVTGVGTTVVEGIQQTAKAEHNVKLIKNTNVAPYNGVVSIGSG

TGFIVGKNTIVTNKHVVAGMEIGAHIIAHPNGEYNNGGFYKVKKIVRYSGQEDIAILHVE

DKAVHPKNRNFKDYTGILKIASEAKENERISIVGYPEPYINKFQMYESTGKVLSVKGNMI

ITDAFVEPGNSGSAVFNSKYEVVGVHFGGNGPGNKSTKGYGVYFSPEIKKFIADNTDK

>G1333_STAAU8325, UNDEFINED PRODUCT 1288095:1288811 FORWARD
MW: 25655
MNKNIIIKSIAALTILTSITGVGTTMVEGIQQTAKAENTVKQITNTNVAPYSGVTWMGAG

TGFVVGNHTIITNKHVTYHMKVGDEIKAHPNGFYNNGGGLYKVTKIVDYPGKEDIAVVQV

EEKSTQPKGRKFKDFTSKFNIASEAKENEPISVIGYPNPNGNKLQMYESTGKVLSVNGNI

VSSDAIIQPGSSGSPILNSKHEAIGVIYAGNKPSGESTRGFAVYFSPEIKKFIADNLDK

>G1334FRAG._STAAU8325, UNDEFINED PRODUCT 1288994:1290730
FORWARD MW: 66904
MILKAFESYNISIKFFNNNCATKTQNFHHQHPNYQHRNITKCYNKSITQRDKLLMQRRRN

HMSITEKQRQQQAELHKKLWSIANDLRGNMDASEFRNYILGLIFYRFLSEKAEQEYADAL

SGEDITYQEAWADEEYREDLKAELID

ORF1 (AF7)
SGTGFIVGKNTIVTNKHVVAGMEIGAHIIAHPNGEYNNGGFYKVKKIVRYSGQEDIAILH

VEDKAVHPKNRNFKDYTGILKIASEADENERISIVGYPEPYINKFQMYESTGKVLSVKGN

MIITDAFVEPGNSGSAVFNSKYEVVGVHFGGNGPGNKSTKGYGVYFSPEIKKFIADNTDK

ORF2 (AF7)
MNKNIIIKSIAALTILTSITGVGTTMVEGIQQTAKAENTVKQITNTNVAPYS

GVTWMGAGTGFVVGNHTIITNKHVTYHMKVGDEIKAHPNGFYNNGGGLYKVTKIVDYPGK

EDIAVVQVEEKSTQPKGRKFKDFTSKFNIASEAKENEPISVIGYPNPNGNKLQMYESTGK
```

TABLE 7-continued

```
VLSVNGNIVSSDAIIQPGSSGSPILNSKHEAIGVIYAGNKPSGESTRGFAVYFSPEIKKF

IADNLDK

LOCUS 28 (H130)
>G1388_STAAU8325, UNDEFINED PRODUCT 1337496:1338446 REVERSE
MW: 36053
MGNHFQYAFENKRYHTWNYHLKNKFGQKIFKVALDGGFDCPNRDGTVAHGGCTFCSAAGS

GDFAGNRADSIAVQFKEIKEKMHEKWHEGKYIAYFQAFTNTHAPVEVLKEKFEPVLKEPG

VVGLSIGTRPDCLPDDVVEYLADLNQRTYLWVELGLQTIHQSTSDLINRAHDMKTYYDGV

AKLRKHNINVCTHIINGLPGEDYDMMMATAKEVAQMDVQGIKIHLLHLLKGTPMVKQYDK

GLLTFMTQEEYTNLVVDQLEVIPPEMIVHRITGDGPIDIMVGPMWSVNKWEVLNGIDAEL

ARRNSYQGLRYKSKVKQ

>G1389_STAAU8325, UNDEFINED PRODUCT 1338556:1339734 FORWARD
MW: 43345
MNIPKSVWWLVIGMALNITGSSFLWPLNTIYMKQELGKSLTVAGLVLMINSFGMVIGNLL

GSSLFDKLGGYKTILIGTFTCLCSTTLLNFFHGWPWYAVWLVMLGFGGGMIIPAIYAMAG

AVWPNGGRQTFNAIYLAQNIGVAVGAAMGGFVAEFSFNYIFLANLIMYVVFALVAVTQFN

IEINAKVKYPTHLDITGKKNKARFISLVLICAMFAICWVAYIQWESTIASFTQSINISMA

QYSVLWTINGIMILVAQPLIKPILYLLKGNLKKQMFVGIIIFMLSFFVTSFAENFTIFVV

GMIILTFGEMFVWPAVPTIANQLAPDGKQGQYQGFVNSAATVGKAFGPFLGGVLVDAFNM

RMMFIGMMLLLVFALILLMVFKENNTQPKKIDA

>G1390_STAAU8325, UNDEFINED PRODUCT 1340025:1342439 FORWARD
MW: 91754
VLNYNHNQIEKKWQDYWDENKTFKTNDNLGQKKFYALDMFPYPSGAGLHVGHPEGYTATD

IISRYKRMQGYNVLHPMGWDAFGLPAEQYALDTGNDPREFTKKNIQTFKRQIKELGFSYD

WDREVNTTDPEYYKWTQWIFIQLYNKGLAYVDEVAVNWCPALGTVLSNEEVIDGVSERGG

HPVYRKPMKQWVLKITEYADQLLADLDDLDWPESKLDMQRNWIGRSEGAKVSFDVDNTEG

KVEVFTTRPDTIYGASFLVLSPEHALVNSITTDEYKEKVKAYQEEASKKSDLERTDLAKD

KSGVFTGAYATNPLSGEKVQIWIADYVLSTYGTGAIMAVPAHDDRDYEFAKKFDLPIIEV

IEGGNVEEAAYTGEGKHINSGELDGLENEAAITKAIQLLEQKGAGEKKVNYKLRDWLFSR

QRYWGEPIPVIHWEDGTMTTVPEEELPLLLPETDEIKPSGTGESPLANIDSFVNVVDEKT

GMKGRRETNTMPQWAGSCWYYLRYIDPKNENMLADPEKLKHWLPVDLYIGGVEHAVLHLL

YARFWHKVLYDLAIVPTKEPFQKLFNQGMILGEGNEKMSKSKGNVINPDDIVQSHGADTL

RLYEMFMGPLDAAIAWSEKGLDGSRRFLDRVWRLMVNEDGTLSSKIVTTNNKSLDKVYNQ

TVKKVTEDFETLGFNTAISQLMVFINECYKVDEVYKPYIEGFVKMLAPIAPHIGEELWSK

LGHEESITYQPWPTYDEALLVDDEVEIVVQVNGKLRAKIKIAKDTSKEEMQEIALSNDNV

KASIEGKDIMKVIAVPQKLVNIVAK

LOCUS 29A (N10/GE2)
>G2804_STAAU8325, UNDEFINED PRODUCT 2682166:2682924 REVERSE
MW: 29096
MAYISLNYHSPTIGMHQNLTVILPEDQSFFNSDTTVKPLKTLMLLHGLSSDETTYMRYTS

IERYANEHKLAVIMPNVDHSAYANMAYGHSYYDYILEVYDYVHQIFPLSKKRDDNFIAGH

SMGGYGTIKFALTQGDKFAKAVPLSAVFEAQNLMDLEWNDFSKEAIIGNLSSVKGTEHDP

YYLLDKAVAEDKQIPKLLIMCGKQDFLYQDNLDFIDYLSRINVPYQFEDGPGDHDYAYWD

QAIKRAITWMVND
```

TABLE 7-continued

>G2805_STAAU8325, UNDEFINED PRODUCT 2683043:2685673 REVERSE
MW: 93576
LKKRIDYLSNKQNKYSIRRFTVGTTSVIVGATILFGIGNHQAQASEQSNDTTQSSKNNAS

ADSEKNNMIETPQLNTTANDTSKISANTNSANVDSTTKPMSTQTSNTTTTEPASTNETPQ

PTAIKNQATAAKMQDQTVPQEANSQVDNKTTNDANSIATNSELKNSQTLDLPQSSPQTIS

NAQGTSKPSVRTRAVRSLAVAEPVVNAADAKGTNVNDKVTASNFKLEKTTFDPNQSGNTF

MAANFTVTDKVKSGDYFTAKLPDSLTGNGDVDYSNSNNTMPIADIKSTNGDVVAKATYDI

LTKTYTFVFTDYVNNKENINGQFSLPLFTDRAKAPKSGTYDANINIADEMFNNKITYNYS

SPIAGIDKPNGANISSQIIGVDTASGQNTYKQTVFVNPKQRVLGNTWVYIKGYQDKIEES

SGKVSATDTKLRIFEVNDTSKLSDSYYADPNDSNLKEVTDQFKNRIYYEHPNVASIKFGD

ITKTYVVLVEGHYDNTGKNLKTQVIQENVDPVTNRDYSIFGWNNWNVVRYGGGSADGDSA

VNPKDPTPGPPVDPEPSPDPEPEPTPDPEPSPDPEPEPSPDPDPDSDSDSDSDSDSGS

DSDSESDSDSDSDSDSDSDSESDSDSESDSESDSDSDSDSDSDSDSDSDSDSDSDSDSDS

DSDSDSDSDSDSDSDSDSDSDSDSDSDSDSDSDSDSDSDSDSDSDSDSDSDSDSDSDSDS

DSDSDSDSDSDSDSDSDSDSDSDSDSDSDSDSDSDSDSDSDSDSDSDSDSDSDSDSDSDS

DSDSDSDSDSDSDSDSDSDSDSRVTPPNNEQKAPSNPKGEVNHSNKVSKQHKTDALPE

TGDKSENTNATLTGAMMALLGSLLLFRKRKQDHKEKA

>G2806_STAAU8325, UNDEFINED PRODUCT 2686026:2686727 REVERSE
MW: 27428
MTENFILGRNNKLEHELKALADYINIPYSILQPYQSECFVRHYTKGQVIYFSPQESSNIY

FLIEGNIIREHYNQNGDVYRYFNKEQVLFPISNLFHPKEVNELCTALTDCTVLGLPRELM

AFLCKANDDIFLTLFALINDNEQQHMNYNMALTSKFAKDRIIKLICHLCQTVGYDQDEFY

EIKQFLTIQLMSDMAGISRETAGHIIHELKDEKLVVKDHKNWLVSKHLFNDVCV

LOCUS 30 (N15)
G2078_STAAU8325, UNDEFINED PRODUCT 1955555:1957645 REVERSE
MW: 77813
MQKAFRNVLVIVIIGVIIFGLFSYLNGNGNMPKQLTYNQFTEKLEKGDLKTLEIQPQQNV

YMVSGKTKNDEDYSSTILYNNEKELQKITDAAKKQNGVKLTIKEEEKQSVFVSILSTLIP

VVVIALLFIFFLSQAQGGGSGGRMMNFGKSKAKMYDNNKRRVRFSDVAGADEEKQELIEI

VDFLKDNKKFKEMGSRIPKGVLLVGPPGTGKTLLARAVAGEAGAPFFSISGSDFVEMFVG

VGASRVRDLRDNAKKNAPCIIFIDEIDAVGRQRGAGVGGGHDEREQTLNQLLVEMDGFGE

NEGIIMIAATNRPDILDPALLRPGRFDRQIQVGRPDVKGREAILHVHAKNKPLDETVDLK

AISQRTPGFSGADLENLLNEASLIAVREGKKKIDMRDIEEATDRVIAGPAKKSRVISKKE

RNIVAHHEAGHTIIGMVLDEAEVVHKVTIVPRGQAGGYAMMLPKQDRFLMTEQELLDKIC

GLLGGRVSEDINFNEVSTGASNDFERATQIARSMVTQYGMSKKLGPLQFGHSNGQVFLGK

DMQGEPNYSSQIAYEIDKEVQRIVKEQYERCKQILLEHKEQLILIAETLLTEETLVAEQI

QSLFYEGKLPEIDYDAAKVVKDEDSEFNDGKFGKSYEEIRKEQLEDGQRDESEDRKEEKD

IAEDKKEADKSDEKDEPAHRQAPNIEKPYDPNHPDNK

>G2077_STAAU8325, UNDEFINED PRODUCT 1954445:1955323 REVERSE
MW: 31822
MTHDYIVKALAFDGEIRAYAALTTETVQEAQTRHYTWPTASAAMGRTMTATAMMGAMLKG

DQKLTVTVDGQGPIGRIIADANAKGEVRAYVDHPQTHFPLNEQGKLDVRRAVGTNGSIMV

VKDVGMKDYFSGASPIVSGELGEDFTYYYATSEQTPSSVGLGVLVNPDNTIKAAGGFIIQ

TABLE 7-continued

VMPGAKDETISKLEKAISEMTPVSKLIEQGLTPEGLLNEILGEDHVQILEKMPVQFECNC

SHEKFLNAIKGLGEAEIQNMIKEDHGAEAVCHFCGNKYKYTEEELNVLLESLA

LOCUS 31
>G2117_STAAU8325, UNDEFINED PRODUCT 1991063:1995499 REVERSE
MW: 170933
DQLDVVNRWRGQETYKTMAVPLGVRGKDDILSLNLH

EKAHGPHGLVAGTTGSGKSEIIQSYILSLAINFHPHEVAFLLIDYKGGGMANLFKDLVHL

VGTITNLDGDEAMRALTSIKAELRKRQRLFGEHDVNHINQYHKLFKEGIATEPMPHLFII

SDEFAELKSEQPDFMKELVSTARIGRSLGIHLILATQKPSGVVDDQIWSNSKFKLALKVQ

DRQDSNEILKTPDAADITLPGRAYLQVGNNEIYELFQSAWSGATYDIEGDKLEVEDKTIY

MINDYGQLQAINKDLSGLEDEETKENQTELEAVIDHIESITTRLEIEEVKRPWLPPLPEN

VYQEDLVETDFRKLWSDDAKEVELTLGLKDVPEEQYQGPMVLQLKKAGHIALIGSPGYGR

TTFLHNIIFDVARHHR

LOCUS 32 HE9
>G2647_STAAU8325, UNDEFINED PRODUCT 2528508:2529707 REVERSE
MW: 44138
VINMLYLEVLKNRNFTYLLIGNFLRRSCFVLFSLQIIWFTVELTNQSSLKLSMMVMSQTL

PFIIFGIFGGAYSDKHNKKKILYLS

LOCUS 32 P9
>G2648_STAAU8325, UNDEFINED PRODUCT 2530085:2534971 REVERSE
MW: 178787
DPKLPTGEKEEVPGKPGIKNPETGDVVR

PPVDSVTKYGPVKGDSIVEKEEIPFEKERKFNPDLAPGTEKVTREGQKGEKTITTPTLKN

PLTGEIISKGESKEEITKDPINELTEYGPETITPGHRDEFDPKLPTGEKEEVPGKPGIKN

PETGDVVRPPVDSVTKYGPVKGDSIVEKEEIPFEKERKFNPDLAPGTEKVTREGQKGEKT

ITTPTLKNPLTGVIISKGEPKEEITKDPINELTEYGPETITPGHRDEFDPKLPTGEKEEV

PGKPGIKNPETGDVVRPPVDSVTKYGPVKGDSIVEKEEIPFKKERKFNPDLAPGTEKVTR

EGQKGEKTITTPTLKNPLTGEIISKGESKEEITKDPINELTEYGPETITPGHRDEFDPKL

PTGEKEEVPGKPGIKNPETGDVVRPPVDSVTKYGPVKGDSIVEKEEIPFEKERKFNPDLA

PGTEKVTREGQKGEKTITIPTLKNPLTGEIISKGESKEEITKDPINELTEYGPETITPGH

RDEFDPKLPTGEKEEVPGKPGIKNPETGDVVRPPVDSVTKYGPVKGDSIVEKEEIPFKKE

RKFNPDLAPGTEKVTREGQKGEKTITTPTLKNPLTGEIISKGESKEEITKDPINELTEYG

PETITPGHRDEFDPKLPTGEKEEVPGKPGIKNPETGDVVRPPVDSVTKYGPVKGDSIVEK

EEIPFEKERKFNPDLAPGTEKVTREGQKGEKTITTPTLKNPLTGEIISKGESKEEITKDP

INELTEYGPETITPGHRDEFDPKLPTGEKEEVPGKPGIKNPETGDVVRPPVDSVTKYGPV

KGDSIVEKEEIPFEKERKFNPDLAPGTEKVTREGQKGEKTITTPTLKNPLTGEIISKGES

KEEITKDPVNELTEFGGEKIPQGHKDIFDPNLPTDQTEKVPGKPGIKNPDTGKVIEEPVD

DVIKHGPKTGTPETKTVEIPFETKREFNPKLQFGEERVKQEGQPGSKTITTPITVNPLTG

EKVGEGQPTEEITKQPVDKIVEFGGEKPKDPKGPENPEKPSRPTHPSGPVNPNNPGLSKD

RAKPNGPVHSMDKNDKVKKSKIAKESVANQEKKRAELPKTGLESTQKGLIFSSIIGIAGL

MLLARRRKN

LOCUS 33
>G2811_STAAU8325, UNDEFINED PRODUCT 2691933:2692430 REVERSE
MW: 19378
MNLFFNTRNVTTKGVYNMKKSKRLEIVSTIVKKHKIYKKEQIISYIEEYFGVRYSATTIA

TABLE 7-continued

KDLKELNIYRVPIDCETWIYKAINNQTEQEMREKFRHYCEHEVLSSIINGSYIIVKTSPG

FAQGINYFID

>G2812_STAAU8325, UNDEFINED PRODUCT 2692749:2694275 REVERSE
MW: 56329
QATLITNEDENFVKDEQRAGVDANYYAKQTYDYYKDTFGRESYDN

QGSPIVSLTHVNNYGGQDNRNNAAWIGDKMIYGDGDGRTFTSLSGANDVVAHELTHGVTQ

ETANLEYKDQSGALNESFSDVFGYFVDDEDFLMGEDVYTPGKEGDALRSMSNPEQFGQPA

HMKDYVFTEKDNGGVHTNSGIPNKAAYNVIQAIGKSKSEQIYYRALTEYLTSNSNFKDCK

DALYQAAKDLYDEQTAEQVYEAWNEVGVE

LOCUS 34
>G1540_STAAU8325, UNDEFINED PRODUCT 1494147:1495196 FORWARD
MW: 38745
MTKHYLNSKYQSESQRSSAMKKITMGTASILGSLVYIGADSQQVNAATEATNATNNQSTQ

VSQATSQPINFQVQKDGSSEKSHMDDYMQHPGKVIKQNNKYYFQTVLNNASFWKEYKFYN

ANNQELATTVVNDNKKADTRTINVAVEPGYKSLTTKVHIVVPQINYNHRYTTHLEFEKAI

PTLADAAKPNNVKPVQPKPAQPKTPTEQTKPVQPKVEKVKPTVTTTSKVEDNHSTKVVST

DTTKDQTKTQTAHTVKTAQTAQEQNKVQTPVKDVATAKSESNNQAVSDNKSQQTNKVTKH

NETPKQASKAKELPKTGLTSVDNFISTVAFATLALLGSLSLLLFKRKESK

>G1539_STAAU8325, UNDEFINED PRODUCT 1493258:1493938 REVERSE
MW: 24836
LKNILKVFNTTILALIIIATFSNSANAADSGTLNYEVYKYNTNDTSIANDYFNKPAKYI

KKNGKLYVQITVNHSHWITGMSIEGHKENIISKNTAKDERTSEFEVSKLNGKIDGKIDVY

EDEKVNGKPFKYDHHYNITYKFNGPTDVAGANAPGKDDKNSASGSDKGSDGTTTGQSESN

SSNKDKVENPQTNAGTPAYIYAIPVASLALLIAITLFVRKKSKGNVE

LOCUS 35 P15
>G2062_STAAU8325, UNDEFINED PRODUCT 1927377:1928480 FORWARD
MW: 40937
NSYLSDEVTRVGRGTLRKIGPKDRIIKPLT

YLYNKDLERTGLLNTAALLLKYDDTADQETVEKNNYIKEHGLKAFLSEYAKVDDGLADEI

IEAYNSLS

>O2063_STAAU8325, UNDEFINED PRODUCT 1928805:1936238 REVERSE
MW: 263021
AVVTANADIDNAAANNDVDNAKTTNEATIAAITPDANVKPAAKQAIADKV

QAQETAIDGNNGSTTEEKAAAKQQVQTEKTTADAAIDAAHTNAEVEAAKKAAIAKIEAIQ

PATTTKDNAKEAIATKANERKTAIAQTQDITAEEIAAANADVDNAVTQANSNIEAANSQN

DVDQAKTTGENSIDQVTPTVNKKATARNEITAILNNKLQEIQATPDATDEEKQAADAEAN

TENGKANQAISAATTNAQVDEAKANAEAAINAVTPKVVKKQAADKEIDQLQATQTNVINN

DQNATTEEKEAAIQQLATAVTDAKNNITAATDDNGVDQAKDAGKNSIQSTQPATAVKSNA

KNDVDQAVTTQNQAIDNTTGATTEEKNAAKDLVLKAKEKAYQDIINAQTTNDVTQIKDQA

VADIQGITADTTIKDVAKDELATKANEQKALIAQTADATTEEKEQANQQVDAQLTQGNQN

IENAQSIDDVNTAKDNAIQAIDPIQASTDVKTNARAELLTEMQNKITEILNNNETTNEEK

GNDIGPVRAAYEEGLNNINAATTTGDVTTAKDTAVQKVQQKHANPVKKPAGKKELDQAAA

DKKTQIEQTPNASQQEINDAKQEVDTELNQAKTNVDQSSTNEYVDNAVKEGKAKINAVKT

FSEYKKDALAKIEDAYNAKVNEADNSNASTSSEIAEAKQKLAELKQTADQNVNQATSKDD

IEVQIHNDLDNINDYTIPTGKKESATTDLYAYADQKKNNISADTNATQDEKQQAIKQVDQ

NVQTALESINNGVDNGDVDDALTQGKAAIDAIQVDATVKPKANQAIEVKAEDTKESIDQS

TABLE 7-continued

DQLTAEEKTEALAMIKQITDQAKQGITDATTTAEVEKAKAQGLEAFDNIQIDSTEKQKAI

EELETALDQIEAGVNVNADATTEEKEAFTNALEDILSKATEDISDQTTNAEIATVKNSAL

EQLKAQRINPEVKKNALEAIREVVNKQIEIIKNADADASAKEIARTDLGRYFDRFADKLD

KTQTNAEVAELQNVTIPAIEAIVPQNDPDANDTNNGIDNNDATANSNANATPENTGQPNV

SETTANGKADASPTTPNNSDAATGETTATSATDDANDKPQANNNSSVDASTNSPTMDNDV

TSKPEVESTNNGTTDKPVTETDNATPAESTTNNNSTTTATNENAPTGSTATAPTTASTEA

ASSADSKDNASVNDSKQNAEVNNSAESQSTNDKVAQPKSENKAKAEKDGSDSTNQSMVES

TTETLPSADITEPNVPSNTSKDKEESTTNQTDAGQLKSETNVASNEADKSPSKADTEVSN

KPSTSASSEAKEKMTSTNVSQKDDTATADTNDTQKSVGSAANNKATQNDGANASPATVSN

GSNSANQDMLNVTNTDDHQAKTKSAQQGKVNKAKQQAKTLPDTGMSHNDDLPYAELALGA

GMAFLIRRFTKKDQQTEE

LOCUS 36
>G2732_STAAU8325, UNDEFINED PRODUCT 2619995:2620498 REVERSE
MW: 19899
MKKEIKMAINIIEYNRSYKEELIEFILSIQKNEFNIKIDRDDQP

>G2733_STAAU8325, UNDEFINED PRODUCT 2620759:2621457 REVERSE
MW: 24203
MKKTIMASSLAVALGVTGYAAGTGHQAHAAEVNVDQAHLVDLAHNHQDQLNAAPIKDGAY

DIHFVKDGFQYNFTSNGTTWSWSYEAANGQTAGFSNVAGADYTTSYNQGSNVQSVSYNAQ

SSNSNVEAVSAPTYHNYSTSTTSSSVRLSNGNTAGATGSSAAQIMAQRTGVSASTWAAII

ARESNGYVNAYNPSGASGLFQTMPGWGPTNTVDQQINAAVKAKKAQGLGAWGF

>G2734_STAAU8325, UNDEFINED PRODUCT 2622068:2623216 REVERSE
MW: 40979
SASIGISATEAVLIIGTSKVNRLGVPLSVFFGGVKMMIPNMVKYPILMLPILTTA

IVSGLVSALVGIHGTKESAGFGFIGMVGPINAFKFMEVDSAWLSVLLIVVAFFVVPFVTA

WLADIIYRKVFRLYTNDIFKFMG

LOCUS 37
>G2805_STAAU8325, UNDEFINED PRODUCT 2683043:2685673 REVERSE
MW: 93576
LKKRIDYLSNKQNKYSIRRFTVGTTSVIVGATILFGIGNHQAQASEQSNDTTQSSKNNAS

ADSEKNMIETPQLNTTANDTSDIASANTNSANVDSTTKPMSTQTSNTTTTEPASTNETPQ

PTAIKNQATAAKMQDQTVPQEANSQVDNKTTNDANSIATNSELKNSQTLDLPQSSPQTIS

NAQGTSKPSVRTRAVRSLAVAEPVVNAADAKGTNVNDKVTASNFKLEKTTFDPNQSGNTF

MAANFTVTDKVKSGDYFTAKLPDSLTGNGDVDYSNSNNTMPIADIKSTNGDVVAKATYDI

LTKTYTFVFTDYVNNKENINGQFSLPLFTDRADAPKSGTYDANINIADEMFNNKITYNYS

SPIAGIDKPNGANISSQIIGVDTASGQNTYKQTVFVNPKQRVLGNTWVYIKGYQDKIEES

SGKVSATDTKLRIFEVNDTSKLSDSYYADPNDSNLKEVTDQFKNRIYYEHPNVASIKFGD

ITKTYVVLVEGHYDNTGKNLKTQVIQENVDPVTNRDYSIFGWNNENVVRYGGGGADGDSA

VNPKDPTPGPPVDPEPSPDPEPEPTPD

>G2806_STAAU8325, UNDEFINED PRODUCT 2686026:2686727 REVERSE
MW: 27428
DHKNWLVSKHLFNDVCV

LOCUS 38
>G0307_STAAU8325, UNDEFINED PRODUCT 273255:274481 REVERSE
MW: 45016
ILVVLNLFLAWFFIYFDWGQKAVRGAA

NGIAWVVQSAHAGTGFAFASLTNVKMMDMAVAALFPILLIVPLFDILMYFNILPKIIGGI

TABLE 7-continued

```
GWLLAKVTRQPKFESFFGIEMMFLGNTEALAVSSEQLKRMNEMRVLTIAMMSMSSVSGAI

VGAYVQMVPGELVLTAIPLNIVNAIIVSCLLNPVSVEEKEDIIYSLKNNEVERQPFFSFL

GDSVLAAGKLVLIIIAFVISFVALADLFDRFINLITGLIAGWIGIKGSFGLNQILGVFMY

PFALLLGLPYDEAWLVAQQMAKKIVTNEFVVMGEISKDIASYTPHHRAVITTFLISFANF

STIGMIIGTLKGIVDKKTSDFVSKYVPMMLSGILVSLLTAAFVGLFAW

LOCUS 39
>G0761_STAAU8325, UNDEFINED PRODUCT 754164:754763 REVERSE
MW: 23413
MRISMEGFSVINFDNFKKYQESFGYMAQQLCFPEKLTFHPKTFEETISK

>G0762_STAAU8325, UNDEFINED PRODUCT 754732:756288 REVERSE
MW: 59413
LKIKAQVAMVLNLDKCIGCHTCSVTCKNTWTNRPGAEYMWFNNVETKPGVGYPKRWEDQE

HYKGGWVLNRKGKLELKSGSRISKIALGKIFYNPDMPLIKDYYEPWNYNYEHLTTAKSGK

HSPVARAYSEITGDNIEIEWGPNWEDDLAGGHVTGPKDPNIQKIEEDIKFQFDETFMMYL

PRLCEHCLNPSCVASCPSGAMYKRDEDGIVLVDQDACRGWRYCMTGCPYKKVYFNWKTNK

AEKCTFCFPRIEAGMPTVCSETCTGRMRYLGVLLYDADRVHEAASAVDEKDLYEKQLDIF

LNPFDEEVIAQAEKDGIGYDWIEAAQNSPIYKLAIEYKLAFPLHPEFRTMPMVWYCPPLS

PIMSYFEGKNTTQNPDAIFPAIEEMRLPIEYLANIFTAGDTEPVKGALQRMAMMRSYMRS

QVTQQPFDTSRLERLGITERQTKDMYRLLGLAKYEDRFVIPTSHKETYLDTYHAQGSTGY

NYGGEHFGDNCEGCGVAVGSGKTGQEIYNENFYGGIFRD

>G0763_STAAU8325, UNDEFINED PRODUCT 756281:759967 REVERSE
MW:139830
DHEVFQQFGESLPVYKPTLPPMVFGNRDKKIKGGTDALVL

RYLTPHGKWNIHSMYQDNKHMLTLFRGGPTVWISNEDAEKHDIQDNDWLEVYNRNGVVTA

RAVISHRMPKGTMFMYHAQDKHIQTPGSEITDTRGGSHNAPTRIHLKPTQLVGGYAQISY

HFNYYGPIGNQRDLYVAVRKMKEVNWLED

LOCUS 40
>G2781_STAAU8325, UNDEFINED PRODUCT 2662464:2663147 REVERSE
MW: 26238
MTNQFKNKQSKLHDSLESITKNLYATPTSELPFDNRFLFKSFILKRETGNIVIYHSGHLG

DSQQDIASLGGVSKVLMNH

>G2782_STAAU8325, UNDEFINED PRODUCT 2663414:2665033 REVERSE
MW: 60237
LKKEKVMDWTTFIGTVAVLLFAVIPMMAFPKASEDIITGINSAISDSIGSIYLFMGLAIF

CFVMYIAFGKYGNVTLGKASDKPEFNTFTWAAMLFCAGIGSDILYWGVIEWAFYYQVPPN

GAKSMSDEALQYATQYGMFHWGPIAWAIYVLPALPIGYLVFVKKQPVYKISQACRPILKG

QTDKFVGKVVDILFIFGLLGGAATSLALGVPLISAGIERLTGLDGKNMILRSAILLTITV

IFAISSYTGLKKGIQKLSDINVWLSFVLLAFIPIIGPTVFIMETTVTGFGNMLRDFFHMA

TWLEPFGGIKGRKETNFPQDWTIFYWSWWLVYAPFIGLFIARISKGRRLKEVVLGTIIYG

TLGCVLFFGIFGNYAVYLQISGQFNVTQYLNTHGTEATIIEVVHHLPFPSLMIVLFLVSA

FLFLATTFDSGSYILAAASQKKVVGEPKRANRLFWAFALCLLPFSLMLVGGERALEVKLT

ASILASVPLIVIFIFMNISFLIILGRDRIKLETRAEKLKEVERRSLRIVQVSEEEQDDNL

>G2787_STAAU8325, UNDEFINED PRODUCT 2666088:2667935 REVERSE
MW: 70480
DHCYECDYDGDFEATEKGFKCPNCGNDNPKTVDVVKRTCGYLGNPVQRPVIKGR

HKEICARVKHMKAPKE
```

TABLE 7-continued

```
LOCUS 41
>G2567_STAAU8325, UNDEFINED PRODUCT 2448105:2448794 REVERSE
MW: 25305
LISMEWILFDKDGTLIEFDRSWEKIGVRFVQSLLETFPVHNKEAALRQLGVIKESIDPKS

VMGSGSLQQIIQAFNDVTGQDTTDWSKSTSQKLVDERIPEINWVEGVKEALIDLKAKGYQ

LGIVTSDTKKGVEQFLAHTNATSLFDLIISTEADAYEKPNPKVLSPLFEQYNVD

>G2568_STAAU8325, UNDEFINED PRODUCT 2448892:2449062 REVERSE
MW: 6765
LESRCTKILIKIEYNHENNMQKLIMTKIPFNEAKHGNKLSLQCLLLSIEGDFTYYYI

>G2569_STAAU8325, UNDEFINED PRODUCT 2449038:2450111 REVERSE
MW: 40086
MSQAVKVERRETLKQKPNTSQLGFGKYFTDYMLSYDYDADKGWHDLKIVPYGPIEISPAA

QGVHYGQSVFEGLKAYKRDGEVALFRPEENFKRLNNSLARLEMPQVDEAELLEGLKQLVD

IERDWIPEGEGQSLYIRPFVFATEGALGVGASHQYKLLIILSPSGAYYGGETLKPTKIYV

EDEYVRAVRGGVGFAKVAGNYAASLLAQTNANKLGYDQVLWLDGVEQKYIEEVGSMNIFF

VENGKVITPELNGSILPGITRKSIIELAKNLGYEVEERRVSIDELFESYDKGELTEVFGS

GTAAVISPVGTLRYEDREIVINNNETGEITQKLYDVYTGIQNGTLEDKNGWRVVVPKY

>G2570_STAAU8325, UNDEFINED PRODUCT 2450449:2451411 REVERSE
MW: 36053
DPKYDLASMTKLMLEAIEQKDTVKNN

LOCUS 42
G2383
>G2383_STAAU8325, UNDEFINED PRODUCT 2270269:2271210 REVERSE
MW: 35868
MSFASEMKNELTRIDVDEMNAKAELSALIRMNGALSLSNQQVFINVQTENATTARRIYSL

IKRVFNVEVEILV

G2384
>G2383_STAAU8325, UNDEFINED PRODUCT 2270269:2271210 REVERSE
MW: 35868
MSFAFEMKNELTRIDVDEMNAKAELSALIRMNGALSLSNQQFVINVQTENATTARRIYSL

IKRVFNVEVEILVRKKMKLKKNNIYICRTKMKEKEILDELGILKDGIFTHEIDHSMIQDD

EMRRSYLRGAFLAGGSVNNPETSSYHLEIFSQNESHAEGLTKLMNSYELNAKHLERKKGS

ITYLKEAEKISDFLSLIGGYQALLKFEDVRIVRDMRNSVNRLVNCETANLNKTVSAAMKQ

VESIKLIDKEIGIENLPDRLREIARIRVEHQEISLKELGEMVSTGPISKSGVNHRLRKLN

DLADKIRNGEQIEL

G2385
>G2385_STAAU8325, UNDEFINED PRODUCT 2272315:2273223 REVERSE
MW: 34812
SLINAINDEREHLSQIRSIANFVIDTTKLSPKELKERIRRYYEDEEFETFTINVT

SFGFKHGIQMDADLVFDVRFLPNPYYVVDLRPLTGLDKDVYNYVMKWKETEIFFEKLTDL

LDFMIPGYKKEGKSQLVIAIGCTGGQHRSVALAERLGNYLNEVFEYNVYVHHRDAHIESG

EKK

G1925
>G1925_STAAU8325, UNDEFINED PRODUCT 1807198:1808076 FORWARD
MW: 33043
DQLIAKYDL

G1926
>G1926_STAAU8325, UNDEFINED PRODUCT 1808110:1809648 FORWARD
MW: 56155
MLPMKEVGFGTLNWVAVIIYLLAMLFIGVYFTKRASQSTNSFFTASGRLPSWVVGFSIYA

TTLSAITFMSTPEKAFLTDWSYIAGNIAIVAIIPLLIYFYVPFFKKLKVTSAYEYLEARF

GPSIRVIGSLLFVVYHLGRVAIVIYLPTLAITSVSDMNPYIVASLVGLLCILYTFLGGFE
```

TABLE 7-continued

GVVWSDFIQGVILLGGALVIIILGVVNIKGGFGTVFADAIEHKKLISADNWKLNTAAAAI

PIIFLGNIFNNLYQYTASQDVVQRYQASDSLKETNKSLWTNGILALISAPLFYGMGTMLY

SFYTHEAVLPKGFNTSSVVPYFILTEMPPFVAGLLIAAIFAAAQSTISSSLNSISACISI

DIKQRFFGKGSERHEVNFARFIIIAGIFGFGMSLYLIASNSNDLWDLFLFVTGLFGVPL

AGVFAVGIFTKRTNTFGVICGLILGIIFAYVYNGVGKGNSPFYVSTISFTVAFVFAYILS

FIVPSKHKKDITGLTIFEKDKPSTYISKTATKK

G1927
>G1927_STAAU8325, UNDEFINED PRODUCT 1809759:1810976 REVERSE
MW: 44221
SKAGINFVFGDIQNKNGFTFFLNVLLPLVFISVLIGIFNYIKVLPFIIKYV

GIAINKITRMGRLESYFAISTAMFGQPEVYLTIKDIIPRLSRAKLYTIATSGMSAVSMAM

LGSYMQMIEPKFVVTAVMLNIFSALIIASVINPYKSDDTDVEIDNLTKSTETKTLNGKTG

KPKKVAFFQMIGDSAMDGFKIAVVVAVMLLAFISLMEAINIMFGSVGLNFKQLIGYVFAP

IAFLMGIPWSEAVPAGSLMATKLITNEFVAMLDFKNVLGDVSARTQGIISVYLVSFANFG

TVGIIVGSIKGISDKQGEKVASFAMRLLLGSTLASIISGSIIGLVL

LOCUS 44
>G2207_STAAU8325, UNDEFINED PRODUCT 2094883:2096472 FORWARD
MW: 59177
PLSSLNPRLTIGKQITEVIFQHKRVSKSEAKSMTIDILEKVGIKHATRQFDAYPHELSGGMR

QRVMIAMALILKPQILIADEPTTALDASTQNQLLQLMKSLYEYTETSIIFITHDLGAVYQFC

DDVIVMKDGSVVESGTV

ESIFKSPQHTYTKRLIDAIPDIHQTRPRRPLNNDILLKFDRVSVDYTSPSGSLYRAVNDI

NLAIRKGETLGIVGESGSGKSTLAKTVVGLKEVSEGFIWYNELPLSLFKDDELKSLRQEI

QMIFQDPFASINPRFKVIDVIKRPLIIHGKVKDNDDIIKTVVSLLEKVGLDQTFLYRYPH

ELSGGQRQRVSIARALAVEPKVIVCDEAVSALDVSIQKDIIELLKQLQLDFGITYLFITH

DMGVINEIC

LOCUS 45
>G2152_STAAU8325, UNDEFINED PRODUCT 2029896:2030945 REVERSE
MW: 39494
DQRYYTGSRDENVLSQKLPMSLIHEGVGEVVFDSKGVFNKGTKVVMVPNTPTEKDDVIA

LOCUS 46 G5(1)
>G2647_STAAU8325, UNDEFINED PRODUCT 2528508:2529707 REVERSE
MW: 44138
VINMLYLEVLKNRNFTYLLIGNFLRRSCFVLFSLQIIWFTVELTNQSSLKLSMMVMSQTL

PFIIFGIFGGAYSDKHNKKKILYLS

>G2648_STAAU8325, UNDEFINED PRODUCT 2530085:2534971 REVERSE
NW: 178787
PKLPTGEKEEVPGKPGIKNPETGDVVR

PPVDSVTKYGPVKGDSIVEKEEIPFEKERKFNPDLAPGTEKVTREGQKGEKTITTPTLKN

PLTGEIISKGESKEEITKDPINELTEYGPETITPGHRDEFDPKLPTGEKEEVPGKPGIKN

PETGDVVRPPVDSVTKYGPVKGDSIVEKEEIPFEKERKFNPDLAPGTEKVTREGQKGEKT

ITTPTLKNPLTGVIISKGEPKEEITKDPINELTEYGPETITPGHRDEFDPKLPTGEKEEV

PGKPGIKNPETGDVVRPPVDSVTKYGPVKGDSIVEKEEIPFKKERKFNPDLAPGTEKVTR

EGQKGEKTITTPTLKNPLTGEIISKGESKEEITKDPINELTEYGPETITPGHRDEFDPKL

PTGEKEEVPGKPGIKNPETGDVVRPPVDSVTKYGPVKGDSIVEKEEIPFEKERKFNPDLA

PGTEKVTREGQKGEKTITTPTLKNPLTGEIISKGESKEEITKDPINELTEYGPETITPGH

RDEFDPKLPTGEKEEVPGKPGIKNPETGDVVRPPVDSVTKYGPVKGDSIVEKEEIPFKKE

TABLE 7-continued

RKFNPDLAPGTEKVTREGQKGEKTITTPTLKNPLTGEIISKGESKEEITKDPINELTEYG

PETITPGHRDEFDPKLPTGEKEEVPGKPGIKNPETGDVVRPPVDSVTKYGPVKGDSIVEK

EEIPFEKERKFNPDLAPGTEKVTREGQKGEKTITTPTLKNPLTGEIISKGESKEEITKDP

INELTEYGPETITPGHRDEFDPKLPTGEKEEVPGKPGIKNPETGDVVRPPVDSVTKYGPV

KGDSIVEKEEIPFEKERKFNPDLAPGTEKVTREGQKGEKTITTPTLKNPLTGEIISKGES

KEEITKDPVNELTEFGGEKIPQGHKDIFDPNLPTDQTEKVPGKPGIKNPDTGKVIEEPVD

DVIKHGPKTGTPETKTVEIPFETKREFNPKLQPGEERVKQEGQPGSKTITTPITVNPLTG

EKVGEGQPTEEITKQPVDKIVEFGGEKPKDPKGPENPEKPSRPTHPSGPVNPNNPGLSKD

RAKPNGPVHSMDKNDKVKKSKIAKESVANQEKKRAELPKTGLESTQKGLIFSSIIGIAGL

MLLARRRKN

LOCUS 47 HF6
>G2560_STAAU8325, UNDEFINED PRODUCT 2436743:2440789 REVERSE
MW: 146086
MLNRENKTAITRKGMVSNRLNKFSIRKYTVGTASILVGTTLIFGLGNQEAKAAESTNKEL

NEATTSASDNQSSDKVDMQQLNQEDNTKNDNQKEMVSSQGNETTSNGNKLIEKESVQSTT

GNKVEVSTAKSDEQASPKSTNEDLNTKQTISNQEALQPDLQENKSVVNVQPTNEENKKVD

AKTESTTLNVKSDAIKSNDETLVDNNSNSNNENNADIILPKSTAPKRLNTRMRIAAVQPS

STEAKNVNDLITSNTTLTVVDADKNNKIVPAQDYLSLKSQITVDDKVKSGDYFTIKYSDT

VQVYGLNPEDIKNIGDIKDPNNGETIATAKHDTANNLITYTFTDYVDRFNSVQMGINYSI

YMDADTIPVSKNDVEFNVTIGNTTTKTTANIQYPDYVVNEKNSIG

>G2561_STAAU8325, UNDEFINED PRODUCT 2441159:2444143 REVERSE
MW: 107795
ETSDS

DSDSDSDSDSDSDSDSDSDSDSDSDSDSDSDSDSDSDSDSDSDSDSDSDSDSDSDSDSDS

DSDSDSDSDSDSDSDSDSDSDSDSDSDSDSDSDSDSDSDSDSDSDSDSDSDSDSDSDSDS

DSDSDSDSDSDSDSDSDNDSDSDSDSDSDSDSDSDSDSDSDSDSDSDSDSDSDSDSDSDS

DSDSDSDSDSDSDSDSDSDSDNDSDSDSDSDSDAGKHTPAKPMSTVKDQHKTAKALPE

TGSENNNSNNGTLFGGLFAALGSLLLFGRRKKQNK

LOCUS 49 B13
G1539
>G1539_STAAU8325, UNDEFINED PRODUCT 1493258:1493938 REVERSE
MW: 24836
LKNILKVFNTTILALIIIIATFSNSANAADSGTLNYEVYKYNTNDTSIANDYFNKPAKYI

KKNGKLYVQITVNHSHWITGMSIEGHKENIISKNTAKDERTSEFEVSKLNGKIDGKIDVY

IDEKVNGKPFKYDHHYNITYKFNGPTDVAGANAPGKDDKNSASGSDKGSDGTTTGQSESN

SSNKDKVENPQTNAGTPAYIYAIPVASLALLIAITLFVRKKSKGNVE

G1540
>G1540_STAAU8325, UNDEFINED PRODUCT 1494147:1495196 FORWARD
MW: 38745
MTKHYLNSKYQSEQRSSAMKKITMGTASIILGSLVYIGADSQQVNAATEATNATNNQSTQ

VSQATSQPINFQVQKDGSSEKSHMDDYMQHPGKVIKQNNKYYFQTVLNNASFWKEYKFYN

ANNQELATTVVNDNKKADTRTINVAVEPGYKSLTTKVHIVVPQINYNHRYTTHLEFEKAI

PTLADAAKPNNVKPVQPKPAQPKTPTEPTKPVQPKVEKVKPTVTTTSKVEDNHSTKVVST

DTTKDQ

TABLE 7-continued

```
LOCUS 49 K16
G1540
>G1540_STAAU8325, UNDEFINED PRODUCT 1494147:1495196 FORWARD
MW: 38745
DQTKTQTAHTVKTAQTAQEQNKVQTPVKDVATAKSESNNQAVSDNKSQQTNKVTKH

NETPKQASKAKELPKTGLTSVDNFISTVAFATLALLGSLSLLLFKRKESK

G1542
>G1542_PL STAAU8325, UNDEFINED PRODUCT 1495403:1497337 FORWARD
MW: 72192
MNKQQKEFKSFYSIRKSSLGVASVAISTLLLMSNGEAQAAAEETGGTNTAEAQPKTEAVA

SPTTTSEKAPETKPVANAVSVSNKEVEAPTSETKEAKEVKEVKAPKETKEVKPAAKATNN

TYPILNQELREAIKNPAIKDKDHSAPNSRPIDFEMKKKDGTQQFYHYASSVKPARVIFTD

SKPEIELGLQSGQFWRKFEVYEGDKKLPIKLVSYDTVKDYAYIRFSVSNGTKAVKIVSST

NFNNKEEKYDYTLMEFAQPIYNSADKFKTEEDYKAEKLLAPYKKAKTLERQVYELNKIQD

KLPEKLKAEYKKKLEDTKKALDEQVKSAITEFQNVQPTNEKMTDLQDTKYVVYESVENNE

SMMDTFVKHPIKTGMLNGKKYMVMETTNDDYWKDFMVEGQRVRTISKDAKNNTRTIIFPY

VEGKTLYDAIVKVHVKTIDYDGQYHVRIVDKEAFTKANTDKSNKKEQQDNSAKKEATPAT

PSKPTPSPVEKESQKQDSQKDDNKQLPSVEKENDASSESGKDKTPATKPTKGEVESSSTT

PTKVVSTTQNVAKPTTASSKTTKDVVQTSAGSSEAKDSAPLQKANIKNTNDGHTQSQNNK

NTQENKAKSLPQTGEESNKDMTLPLMALLALSSIVAFVLPRKRKN

G1543
>G1543_STAAU8325, UNDEFINED PRODUCT 1497540:1497668 REVERSE
MW: 4973
MAVPKRRTSKTRKNKRRTHFKISVPGMTECPNGCRIQIITPCM

G1544
>G1544_STAAU8325, UNDEFINED PRODUCT 1497751:1497846 REVERSE
MW: 3849
MSLLNSKQQDDSESRQVDPRLQKLQQLYDKEQ

G1456
>NONE, UNDEFINED PRODUCT 1497815:1498165 REVERSE MW: 12767
L....QLVIHITGTYTMPCARTLVPVKVPKDVTTTEVFDLEGYNQYNDDQDDVDEHYHII

KDGMVNLQDIVEDIVIIEKPMRAYSEQSDQMLTVGNGWEVIDEDQLDELAKQQATR

LOCUS 50 GB2
>G1392_STAAU8325, UNDEFINED PRODUCT 1343118:1349675 FORWARD
MW: 238192
DPAAAAVGNGGAPVAITAPYTPTTDPNANNAGQNA

PNEVLSFDDNGIRPSTNRSVPTVNVVNNLPGFTLINGGKVGVFSHAMVRTSMFDSGDNKN

YQAQGNVIALGRIHGTDTNDHGDFNGIEKALTVNPNSELIFEFNTMTTKNGQGATNVIIK

NADTNDTIAEKTVEGGPTLRLFKVPDNVRNLKIQFVPKNDAITDARGIYQLKDGYKYYSF

VDSIGLHSGSHVFVERRTMDPTATNNKEFTVTTSLKNNGNSGASLDTNDVFYQVQLPEGV

EYVNNSLTKDFPSNNSGVDVNDMNVTYDAANRVITIKSTGGGTANSPARLMPDKILDLRY

KLRVNNVPTPRTVTFNETLTYKTYTQDFINSAAESHTVSTNPYTIDIIMNKDALQAEVDR

RIQQADYTFASLDIGNGLKRRAQTILDENRNNVPLNKRVSQAYIDSLTNQMQHTLIRSVD

AENAVNKKVDQMEDLVNQNDELTDEEKQAAIQVIEEHKNEIIGNIGDQTTDDGVTRIKDQ

GIQTLSGDTATPVVKPNAKKAIRDKATKQREIINATPDATEDEIQDALNQLATDETDAID

NVTNATTNADVETAKNNGINTIGAVVPQVTHKKAARDAINQATATKRQQINSNREATQEE

KNAALNELTQATNHALEQINQATTNANVDNAKGDGLNAINPIAPVTVVKQAARDAVSHDA

QQHIAEINANPDATQEERQAAIDKVNAAVTAANTNILNANTNADVEQVKTNAIQGIQAIT

PATKVKTDAKNAIDKSAETQHNTIFNNNDATLEEQQAAQQLLDQAVATAKQNINAADTNQ
```

TABLE 7-continued

EVAQAKDQGTQNIVVIQPATQVKTDTRNVVNDKAREAITNINATTGATREEKQEAINRVN

TLKNRALTDIGVTSTTAMVNSIRDDAVNQIGAVQPHVTKKQTATGVLNDLATAKKQEINQ

NTNATTEEKQVALNQVDQELATAINNINQADTNAEVDQAQQLGTKAINAIQPNIVKKPAA

LAQINQHYNAKLAEINATPDATNDEKNAAINTLNQDRQQAIESIKQANTNAEVDQAATVA

ENNIDAVQVDVVKKQAARDKITAEVAKRIEAVKQTPNATDEEKQAAVNQINQLKDQAINQ

INQNQTNDQVD

LOCUS 50 G10
>G1392_STAAU8325, UNDEFINED PRODUCT 1343118:1349675 FORWARD
MW: 238192
DQGTQNIVVIQPATQVKTDTRVVNDKAREAITNINATTGATREEKQEAINRVN

TLKNRALTDIGVTSTTAMVNSIRDDAVNQIGAVQPHVTKKQTATGVLNDLATAKKQEINQ

NTNATTEEKQVALNQVDQELATAINNINQADTNAEVDQAQQLGTKAINAIQPNIVKKPAA

LAQINQHYNAKLAEINATPDATNDEKNAAINTLNQDRQQAIESIKQANTNAEVDQAATVA

ENNID

LOCUS 51 (GC8)
>G2831 FRG_STAAU8325, UNDEFINED PRODUCT 2720353:2721114
FORWARD MW: 27865

DPLMLDESLVDIESLSDALMLIESN

>2832 FRG_STAAU8325, UNDEFINED PRODUCT 2721229:2722446
FORWARD MW: 44105
VLRLVEPLKDIDPLNESESLVLVESLIDIESLSEVDSLTLSEPLNDVEVLNEPDVLVEVE

PLVDFESLNESDSLTLSELLSDVDTLNDDESLVLTESLIDCEQLNELDSLTLSDFLNDVE

TLNEPESLTLVEPLIDLESLSELDSLTLSESPTDSDILCESDMLALITSLADVDVLVESL

NDIDTLIEPDVLALVESDVESLTLSDNDVESLILVDVLVESDILCESLVLVRIEVLVEAD

VLRESLVDVDVLADPDALVLLDVLCESLNDVDVESDSLVLDSVEPDSDVLTDVDKLAMVD

MRFEVDVLSESLNDADVLCESDS

>G2837 FRG_STAAU8325, UNDEFINED PRODUCT 2720004:2726816
REVERSE MW: 228019
ESDSISESTSTSDSISEAISASESTFISLSESNSTS

DSESQSASAFLSESLSESTSESTSESVSSSTSESTSLSDSTSESGSTSTSLSNSTSGSTS

ISTSTSISESTSTFKSESVSTSLSMSTSTSLSDSTSLSTSLSDSTSDSKSDSLSTSMSTS

DSISTSKSDSISTSTSLSGSTSESESDSTSSSESKSDSTSMSISMSQSTSGSTSTSTSTS

LSDSTSTSLSLSASMNQSGVDSNSASQSASNSTSTSTSESDSQSTSSYTSQSTSQSESTS

TSTSLSDSTSISKSTSQSGSVSTSASLSGSESESDSQSISTSASESTSESASTSLSDSTS

TSNSGSASTSTSLSNSASASESDLSSTSLSDSTSASMQSSESDSQSTSASLSDSLSTSTS

NRMSTIASLSTSVSTSESGSTSESTSESDSTSTSLSDSQSTSRSTSASGSASTSTSTSDS

RSTSASTSTSMRTSTSDSQSMSLSTSTSTSMSDSTSLSDSVSDSTSDSTSASTSGSMSVS

ISLSDSTSTSTSASEVMSASISDSQSMSESVNDSESVSESNSESDSKSMSGSTSVSDSGS

LSVSTSLRKSESVSESSSLSCSQSMSDSVSTSDSSSLSVSTSLRSSESVSESDSLSDSKS

TSGSTSTSTSGSLSTSTSLSGSESVSESTSLSDSISMSDSTSTSDSDSLSGSTSLSGSTS

LSTSDSLSDSKSLSSSQSMSGSESTSTSVSDSQSSSTSNSQTDSMSISASESDSMSTSDS

SSISG

LOCUS 52 (E1)
>G0406 FRG_STAAU8325, UNDEFINED PRODUCT 370166:372094 REVERSE
MW: 70979
MTTTFIISYIILALIIVGVINLTLIRSRKKGKRQQKEQQFTTRQSNQSKFKASDLDKTTD

TABLE 7-continued

QSTQRMTHEELRVDNQDDHSQVSLNGYTKGSEKDQEAFTNNKDEEAVAAKNPESEEYKVN

EKIKKEHKNFIFGEGVSRGKILAALLFGMFIAILNQTLLNVALPKINTEFNISASTGQWL

MTGFMLVNGILIPITAYLFNKYSYRKLFLVALVLFTIGSLICAISMNFPIMMVGRVLQAI

GAGVLMPLGSIVIITIYPPEKRGAAMGTMGIAMILAPAIGPTLSGYIVQNYHWNVMPYGM

FIIGIIAILIGFVWFKLYQYTTNAKADIPGIIFSTIGTGALLYGFSEAGNKGWGSVEIET

MFAIGIIFIILFVIRELRMKSPMLNLEVLKFPTFTLTTIINMVVMLSLYGGMILLPIYLQ

NLRGFSALDSGLLLLPGSLIMGLLGPFAGKLLDTIGLKPLAIFGIAVMTYATWELTKLNM

DTPYMTIMGIYVLRSTGMAFIMMPMVTAAINALPGRLASHGNAFLNTMRQLAGSIGTAIL

VTVMTTQTTQHLSAFGEELDKTNP

>G0407 FRG_STAAU8325, UNDEFINED PRODUCT 372110:372754 REVERSE
MW: 23024
MPQKGTIAKLDGMEGSMVQAGNPIAYAYNLDDLYVTANIDEKDIKDVEVGKDVDVTIDGQKA

SIKGKVDSIGKATAASFSLMPSSNSDGNYTKVSQVIPVKITLESEASKQVVAGNNAEVKIHK

N

LOCUS 53 (E20)
>G2244 FRG_STAAU8325, UNDEFINED PRODUCT 2142042:2143301
REVERSE MW: 46800
MKLTVVGLGYIGLPTSIMFAKHGVDVLGVDINQQTIDKLQSGQISTEEAGLQEVYEEVLS

SGKLKVSTTPDASDVFIIAVPTPNNDDQYRSCDISLVMRALDSILSFLEKGNTIIVESTI

APKTMDDFVKPVIENLGFTIGEDIYLVHCPERVLPGKILEELVHNNRIIGGVTEACIEAG

KRVYRTFVQGEMIETDARTAEMSKLMENTYRDVNIALANELTKICNNLNINVLDVIEMAN

KHPRVNIHQPGPGVGGHCLAVDPYFIIAKDPENAKLIQTGREINNSMPAYVVDTTKQIIK

VLSGNKVTVFGLTYKGDVDDIRESPAFDIYELLNQEADIEV

>G2245_STAAU8325, UNDEFINED PRODUCT 2143358:2144242 REVERSE
MW: 33683
MRKNILITGVHGYIGMALKDKLIEQGHQVDQINVRNQLWKSTSFKDYDVLIHTAALVHNN

SPQARLSDYMQVNMLLTKQLAQKAKAEDVKQFIFMSTMAvYGKEGHVGKSDQVDTQTPMN

PTTNYGISKKFAEQALQELISDSFKVAIVRPPMIYGAHCPGNFQRLMQLSKRLPIIPNIN

NQRSALYIKHLTAFIDQLISLEVTGVYHPQDSFYFDTSSVMYEIRRQSHRKTVLINMPSM

LNKYFNKLSVFRKLFGNLIYSNTLYENNNALEIIPGKMSLVIADIMDETTTKDKA

>G2246_STAAU8325, UNDEFINED PRODUCT 2144245:2144799 REVERSE
MW: 21063
MKRLFDVVSSIYGLVVLSPILLITALLIKMESAGPAIFKQKRPTTNNELFNIYKFRSNKI

DTPNVATDLMDSTSYITKTGKVIRKTSIDELPQLLNVLKGEMSIVGPRPALYNQYELIEK

RTKANVHTIRPGVTGLAQVMGRDDITDDQKVAYDHYYLTHQSMMLDMYIIYKTIKNIVTS

EGVHH

>G2247 FRG_STAAU8325, UNDEFINED PRODUCT 2144813:2146015
REVERSE MW: 46577
INTMKYYNLLK

LOCUS 54 (E105)
>G2254 FRG_STAAU8325, UNDEFINED PRODUCT 2152390:2153505
REVERSE MW:42140
MKLKRLFKTSSMTLVKKKLLTMPMAKREIIMFDDKILLI

>G2255_STAAU8325, UNDEFINED PRODUCT 2153408:2155321 REVERSE
MW: 72361
LLMIKKFLNECHNKIINRKDGLGYKQQMRGFMAHLSVKLRLLIALLIDSLIVTFSVFVSY

YILEPYFKTYSVKLLILAAISLFISHHISAFIFNMYHRAWEYASVSELILIVKAVTTSIV

ITMVVVTIVTGNRPFFRLYLITWMMHLILIGGSRLFWRIYRKYLGGKSFNKKPTLVVGAG

TABLE 7-continued

QAGSMLIRQMLKSDEMKLEPVLAVDDDEHKRNITITEGVKVQGKIADIPELVRKYKIKKI

IIAIPTIGQERLKEINNICHMDGVELLKMPNIEDVMSGELEVNQLKKVEVEDLLGRDPVE

LDMDMISNELTNKTILVTGAGGSIGSEICRQVCNFYPERIILLGHGENSIYLTNRELRNR

FGKNVDIVPIIADVQNRARMFEIMETYKPYAVYHAAAHKHVPLMEDNPEEAVRNNILGTK

NTAEAAKNAEVKKFVMISTDKAVNPPNVMGASKRIAEMIIQSLNDETHRTNFVAVRFGNV

LGSRGSVIPLFKSQIEEGGPVTVTHPEMTRYFMTIPEASRLVLQAGALAEGGEVFVLDMG

EPVKIVDLARNLIKLSGKKEDDIRITYTGIRPGEKMFEELMNKDEVHPEQVFEKIYRGKV

QHMKCNEVEAIIQDIVNDFSKEKIINYANGKKGDNYVR

>G2256_STAAU8325, UNDEFINED PRODUCT 2155251:2156012 REVERSE
MW: 29362
DQLFELQSKGFVPIIAHPERNKAISQNLDILYDLINKGALSQVTTASLAGISKKIRKLAI

QMIRENNLTHFIGSDAHNTEIRPFLMKDLFNKKLRDYYEDMNGFISNAKLVVDDKKIPKR

MPQQDYKGQRWFGL

LOCUS 55 (E18)
>G2912 FRG_STAAU8325, UNDEFINED PRODUCT 2797518:2798504
FORWARD MW: 37832
SKSYDERFTPDEVVAYQQHQGNKFKEHFDLNCYLTLLDVLDSHNIDRGRTDVTHVFKNLETK

VLTMGFIDDLLYPDD

LOCUS 56 (F5)
>G1261 FRG_STAAU8325, UNDEFINED PRODUCT 1216923:1217903
FORWARD MW: 36061
HTGKVLLVTEDNLEGSIMSEVSAIIAEHCLFDDLAPIMRLAAPDVPSM

PFSPVLENEIMMNPEKILNKMRELAEF

>G1262_STAAU8325, UNDEFINED PRODUCT 1217919:1219190 FORWARD
MW: 46726
MEITMPKLGESVREGTIEQWLVSVGDHIDEYEPLCEVITDKVTAEVASTISGTITEILVE

AGQTVAIDTIICKIETADEKTNETTEEIQAKVDEHTQKSTKKASATVEQTSTAKQNQPRN

NGRFSPVVFKLASEHDIDLSQVVGSGFEGRVTKKDIMSVIENGGTTAQSDKQVQTKSTSV

DTSSNQSSEDNSENSTIPVNGVRKAIAQNMVNSVTEIPHAWMMIEVDATNLVNTRNHYKN

SFKNKEGYNLTFFAFFVKAVADALKAYPLLNSSWQGNEIVLHKDINISIAVADENKLYVP

VIKHADEKSIKGIAREINTLATKARNKQLTAEDMQGGTFTVNNTGTFGSVSSMGIINHPQ

AAILQVESIVKKPVVINDMIAIRNMVNLCISIDHRILDGLQTGKTMNHIKQRIEQYTLEN

TNIY

>G1263_STAAU8325, UNDEFINED PRODUCT 1219532:1219978 FORWARD
MW: 16676
VIELMDMNFDLYMNGVVEQARNEIESAGYEQLTTAEDVDKVLKQDGTTLVMINSVCGCAG

GIARPAASHALHYDVLPDRLVTVFAGQDKEATQRAREYFEGYAPSSPSFALVKDGKITEM

IERHQIEGHDVMNVINQLQTLFNKYCEER

>G1264_STAAU8325, UNDEFINED PRODUCT 1219995:1220972 FORWARD
MW: 36973
MLKLNPYKIGFRTIKTAVGMTLGVIISKLLGLDNYASSAILVVLCIKHTKVHSLQAIISR

LVSCFLVLFLGSAIFSLLGQSAIVLGIIVLLFIPLTVVLKVQEGVITSCVILLHVFNAKS

IDAHLIVNETLLLLIGLSIAFTMNLMMASLDKQLDEYKCKIEQQIADIFSKYSYICEKYE

DTIAIEFEVLLLNIKKAKSIAFRDVKNHFVRNENSYYHYFDMREEQVELLMRMKPLIESI

CHKD

TABLE 7-continued

LOCUS 57 (F3)
>G0451_STAAU8325, UNDEFINED PRODUCT 410768:412549 FORWARD
MW: 67976
DLRVLMDAIYELNDHQDLREITKDSKMQKLALEGFLKKIKGTYIESLLKEHKLL

>G0452_STAAU8325, UNDEFINED PRODUCT 412872:414536 FORWARD
MW: 60909
MEMSVTEVIFSLFLGGLGIFLYGLKIMGDGLQASAGDRLRDILNKFTSNPVGVIAGIVVT

ILIQSSSGTTVITIGLVTAGFMTLKQAIGVIMGANIGTTVTAFIIGIDLGEYAMPILALG

AFLIFFFKRSKINNIGRILFGFGSLFFGLEFMGDAVKPLASLDGFKQLMLDMSTNPILAV

IVGAGLTALVQSSSATIGILQEFYQQDLISLNAAIFVLLGDNIGTTITAILASLAGSIAA

KRAALVHVIFNLIGVIIFTIFLPVVIHLISLLQDLWHLKPAMTIAVSHGIFNITNTLIQL

PFVAGLAWIVTKLVPGKDIADDYKPQHL

ATVAGLAWTVTKLVAGKDTADDYKAGHL

LOCUS 58 (G8)
>G0922_FRG_STAAU8325, UNDEFINED PRODUCT 915062:915931 REVERSE
NW: 33411
MPELPEVEHVKRGIEPYVINQKIEHVIFSDKVIEGKAQGKETIIKGIELDTFKTLSEGYT

ITNVERRSKYIVFQLDNKREQRTLISHLGMAGGFFIVDELEDIMIPNYRKHWHVIFELSN

DKKLIYSDIRRFGEIRNVASVASYPSFLEIAPEPFSNEALTYYLNRIHQQSNKNKPIKQV

IL

>G0923_FRG STAAU8325, UNDEFINED PRODUCT 915950:918577 REVERSE
NW: 99163
DELIFEVPKSEVDSFSEFVEEIMENALQLDVPLKVDSSYGATWYDAK

LOCUS 59 (G23)
>G2454_FRG_STAAU8325, UNDEFINED PRODUCT 2344101:2344937
REVERSE MW: 32360
NLNEIQILNNGYPMPSVGLGVYKISDEDMTKVVNAAIDAGYRAFDTAYFDNEASLGRAL

KDNGVDREDLFITTKLWNDYQGYEKTFEYFNKSIENLQTDYLDLFLTHWPCEADGLFLET

YKAMEELYEQGKVKAIGVCNFNVHHLEKLMAQSSIKPMVNQIEVHPYFNQQELQ

>G2455_STAAU8325, UNDEFINED PRODUCT 2345162:2346508 REVERSE
MW: 51133
LETSTIISLIIFILLIALTTVFVGSEFALVKIRATRIEQLADEGNKPAKIVKKMIANLDY

YLSACQLGITVTSLGLGWLGEPTFEKLLHPIFEAINLPTALTTTISFAVSFIIVTYLHVV

LGELAPKSIAIQHTEKLALVYARPLFYFGNIMKPLIWLMNGSARVIIRMFGVNPDAQTDA

MSEEEIKIIINNSYNGGEINQTELAYMQNIFSFDERHAKDIMVPRTQMITLNEPFNVDEL

LETIKEHQFTRYPITDDGDKDHIKGFINVKEFLTEYASGKTIKIANYIHELPMISETTRI

SDALIRMQREHVHMSLIIDEYGGTAGILTMEDILEEIVGEIRDEFDDDEVNDIVKIDNKT

FQVNGRVLLDDLTEEFGIEFDDSEDIDTIGGWLQSRNTNLQKDDYVDTTYDRWVVSEIDN

HQIIWVILNYEFNEARPTIGQSDEDEKSE

LOCUS 60 (G29)
G0139_FRG STAAU8325, UNDEFINED PRODUCT 137065:137352 REVERSE
MW: 11080
VMNLAKFSRIKKAGETMATWVAIIFIVAALILGLIGGFLLARKYMMDYLKKNPPINEEML

RMMMMQMGQKPSQK

>NONE, UNDEFINED PRODUCT 137582:139645 REVERSE MW: 75349
VFYLSFYFKISYNVFDKIEEGKIHKMFNEKDQLAVDTLRALSIDTIEKANSGHPGLPMGA

APMAYTLWTRHLNFNPQSKDYFNRDRFVLSAGHGSALLYSLLHVSGSLELEELKQFRQWG

SKTPGHPEYRHTDGVEVTTGPLGQGFAMSVGLALAEDHLAGKFNKEGYNVVDHYTYVLAS

DGDLMEGISHEAASFAGHNKLSKLVVLYDSNDISLDGELNKAFSENTKARFEAYGWNYLL

TABLE 7-continued

VKDGNDLEEIDKAITTAKSQEGPTIIEVKTTIGFGSPNKAGTNGVHGAPLGEVERKLTFE

NYGLDPEKRFNVSEEVYEIFQNTMLKRANEDESQWNSLLEKYAETYAELAEEFKLAISGK

LPKNYKDELPRFELGHNGASRADSGTVIQAISKTVPSFFGGSADLAGSNKSNVNDATDYS

SETPEGKNVWFGVREFAMGAAVNGMAAHGGLHPYGATFFVFSDYLKPALRLSSIMGLNAT

FIFTHDSIAVGEDGPTHEPIEQLAGLRAIPNMNVIRPADGNETRVAWEVALESESTPTSL

VLTRGQLPVLDVPEDVVEEGVRKGAYTVYGSEETPEFLLLASGSEVSLAVEAAKDLEKQG

KSVRVVSMPNWNAFEQQSEEYKESVIPSSVTKRVAIEMASPLGWHKYVGTAGKVIAIDGF

GASAPGDLVVEKYGFTKENILNQVMSL

LOCUS 61 (G28/HA7)
>G2610_FRG STAAU8325, UNDEFINED PRODUCT 2494989:2495441
FORWARD MW: 17293
DLGMDKDEAKKLFAKSESIFKDLKGVKYKVDYKDKKAIEHLDIDYTEVDMKKLNKRLGV

STKENKDISFEKLEKQLKHRGLKEKDKMDDK

G2611_STAAU8325, UNDEFINED PRODUCT 2495615:2497207 REVERSE
MW: 58937
LGGGIVMTFLTVMQFIVNIIVVGFMLTVIVIGLIWLIKDKRQSQHSVLRNYPLLARIRYI

SEKNGPELRQYLFSGDNEGKPFSRNDYKNIVLAGKYNSRMTSFGTTKDYQDGFYIQNTMF

PMQRNEISVDNTTLLSTFIYKIANERLFSREEYRVPTKIDPYYLSDDHAIKLGEHLKHPF

ILKRIVGQSGMSYGALGKNAITALSKGLAKAGTWMNTGEGGLSEYHLKGNGDIIFQIGPG

LFGVRDKEGNFSEGLFKEVAQLSNVRAFELKLAQGAKFRGGHMEAEKVNEEIAKIRNVEP

YKTINSPNRYEFIHNEADLIRFVDQLQQLGQKAVGFKIVVSKVSEIETLVRTMVELDKYP

SFITIDGGEGGTGATTQELQDGVGLPLFTALPIVSGMLEKYGIRDKVKLAASGKLVTPDK

IAIALGLGADFVNIARGMMISVGCIMSQQCHMNTCPVGVATTDAKKEKALIVGEKQYRVT

NYVTSLHEGLTNIAAAVGVSSPTEITADHIVYRKVDGELQTIHDYKLKLIS

LOCUS 62 (H3)
>G2004_STAAU8325, UNDEFINED PRODUCT 1871545:1872954 REVERSE
MW: 51401
MGIGRVTQVMGPVIDVRFEHNEVPKINNALVIDVPKEEGTIQLTLEVALQLGDDVVRTIA

MDSTDGVQRGMDVKDTGKEISVPVGDETLGRVFNVLGETIDLKEEISDSVRRDPIHRQAP

AFDELSTEVQILETGIKVVDLLAPYIKGGKIGLFGGAGVGKTVLIQELINNIAQEHGGIS

VFAGVGERTREGNDLYFEMSDSGVIKKTAMVFGQMNEPPGARMRVALSGLTMAEYFRDEQ

GQDVLLFIDNIFRFTQAGSEVSALLGRMPSAVGYQPTLATEMGQLQERITSTTKG

LOCUS 63 (GD10)
>G2900_FRG STAAU8325, UNDEFINED PRODUCT 2781950:2783308
FORWARD MW: 51966
DPIFKQEVENLEKEIRNV

>G2901_STAAU8325, UNDEFINED PRODUCT 2783589:2784719 FORWARD
MW: 41914
MMEFTIKRDYFITQLNDTLKAISPRTTLPILTGIKIDAKEHEVILTGSDSEISIEITIPK

TVDGEDIVNISETGSVVLPGRFFVDIIKKLPGKDVKLSTNEQFQTLITSGHSEFNLSGLD

PDQYPLLPQVSRDDAIQLSVKVLKNVIAQTNFAVSTSETRPVLTGVNWLIQENELICTAT

DSHRLAVRKLQLEDVSENKNVIIPGKALAELNKIMSDNEEDIDIFFASNQVLFKVGNVNF

ISRLLEGHYPDTTRLFPENYEIKLSIDNGEFY

LOCUS 64 (F5)
>G1261 FRG_STAAU8325, UNDEFINED PRODUCT 1216923:1217903
FORWARD MW: 36061
HTGKVLLVTEDNLEGSIMSEVSAIIAEHCLFDLDAPIMRLAAPDVPSM

PFSPVLENEIMMNPEKILNKMRELAEF

TABLE 7-continued

>G1262_STAAU8325, UNDEFINED PRODUCT 1217919:1219190 FORWARD
MW: 46726
MEITMPKLGESVHEGTIEQWLVSVGDHIDEYEPLCEVITDKVTAEVPSTISGTITEILVE

AGQTVAIDTIICKIETADEKTNETTEEIQAKVDEHTQKSTKKASATVEQTSTAKQNQPRN

NGRFSPVVFKLASEHDIDLSQVVGSGFEGRVTKKDIMSVIENGGTTAQSDKQVQTKSTSV

DTSSNQSSEDNSENSTIPVNGVRKAIAQNMVNSVTEIPHAWMMIEVDATNLVNTRNHYKN

SFKNKEGYNLTFFAFFVKAKADALKAYPLLNSSWQGNEIVLHKDINISIAVADENKLYVP

VIKHADEKSIKGIAREINTLATKARNKQLTAEDMQGGTFTVNNTGTFGSVSSMGIINHPQ

AAILQVESIVKKPVVINDMIAIRNMVNLCISIDHRILDQLQTGKFMNHIKQRIEQYTLEN

TNIY

>G1263_STAAU8325, UNDEFINED PRODUCT 1219532:1219978 FORWARD
MW: 16676
VIELMDMNFDLYMNGVVEQARNEIESAGYEQLTTAEDVDKVLKQDGTTLVMINSVCGCAG

GIARPAASHALHYDVLPDRLVTVTFGQDKEATQRAREYFEGYAPSSPSFALVKDGKITEM

IERHQIEGHDVMNVINQLQTLFNKYCEER

>G1264_STAAU8325, UNDEFINED PRODUCT 1219995:1220972 FORWARD
MW: 36973
MLKLNPYKIGFRTIKTAVGMTLGVIISKLLGLDNYASSAILVVLCIKHTKVHSLQAIISR

LVSCFLVLFLGSAIFSLLGQSPIVLGIIVLLFIPLTVVLKVQEGVITSCVTLLHVTNAKS

IDAHLIVNETLLLLIGLSIAFTMNLMMPSLDKQLDEYKCKIEQQIADIFSKYSYICEKYE

DTIAIEFEVLLLNIKKAKSIAFRDVKNNFVRNENSYYHYFDMREEQVELLMRMKPLIESI

CHKD

LOCUS 65 (F110)
>G2848_STAAU8325, UNDEFINED PRODUCT 2734525:2735082 REVERSE
MW: 21969
LKDKIIDNAITLFSEKGYDGTTLDDIAKSVNIKKASLYYHFDSKKSIYEQSVKCCFDYLN

NIIMMNQNKSNYSIDALYQFLFEFIFDIEERYIRMYVQLSNTPEETSGNIYGQIQDLNQS

LSKEIAKFYDESKIKMTKEDFQNLTLLFLESWYLKASTSQKFGAVEESKSQTKDEVYSLL

NIFLKK

>G2849_STAAU8325, UNDEFINED PRODUCT 2735246:2736481 FORWARD
MW: 47752
LQFFNFLLFYPVFMSIYWIVGSIYFYFTREIRYSLNKKPDINVDELEGITFLLACYNESE

TIEDTLSNVLALKYEKKEIIINDGSSDNTAELIYKIKENNDFIFVDLQENRGKANALNQ

GIKQASYDYVMCLDADTIVDQDAPYYMIENFKHDPKLGAVTGNPRIRNKSSILGKIQTIE

YASLIGCIKRSQTLAGAVNTISGVFTLFKKSAVVDVGYWDTDMITEDIAVSWKLHLRGYR

IKYEPLAMCWMLVPETLGGLWKQRVRWAQGGHEVLLRDFFSTMKTKRFPLYILMFEQIIS

ILWVYIVLLYLGYLFITANFLDYTFMTYSFSIFLLSSFTMTFINVIQFTVALFIDSRYEK

KNMAGLIFVSWYPTVYWIINAAVVLVAFPKALKRKKGGYATWSSPDRGNTQR

>G2850_STAAU8325, UNDEFINED PRODUCT 2736448:2736750 FORWARD
MW: 11783
MVKPRQREYPTLKSSLNIVRETALIAISCVFWIYCLVVLLVYIGTIFEIHDESINTIRVA

LNIENTEILDIFETMGIFAIIIFVFFTISILIQKWQRGRES

>G2851_STAAU8325, UNDEFINED PRODUCT 2736729:2737619 FORWARD
MW: 34958
MAERKRIVKYRKFIILVLSILIILPVSTLDGHHIANADDDSPKKLKYKENSALALNYHRV

RKANFLNNFIYFFSSSKEIKNYSVSQSQFESQIKWLKSHDAKFLTLKEFLYYKKKGKFPK

RSVWINFDDMDETIYENAYPILKKYKIPATGFIITGHVGEENFHNLDMISKKELKEMYKT

TABLE 7-continued

GLWEFETHTHDLHNLSKNNKSLKMKASEATIIKDLNKSEKYLTKNFKKSQKTIAYPYGLM

NDDKLPVIKKAGLKYGFSLEEKAVTPNSNDYYIPRILISDDAFEHLIKRWDGFHEKD

>G2852_STAAU8325, UNDEFINED PRODUCT 2737609:2738658 FORWARD
MW: 41344
MKKIRLELVYLRAIICAIIIITHLLTQITLKHENMEGGSLVLQFYIRNIVIFGTPCFIIL

SQLLTTLNYQKVTYRYLTTRVKYILIPYILMGLFYSYSESLLTDSSFNKQFIENVLLGQW

YGYFIVVIMQFFILSYIIFKINYNLFNSKILLLLSFILQQSFLYYFTNNTAFHDTVLHYY

PLSENTIIFGWIFYFFLGAYMGYNYERVLNFLERYLVIMIVLAVATYFVFIALANGDYWN

VTSFSYSLTPYNSIMFIVILGICTHFKTMLFNTIQMISAFSFFIYLLHPIILDSLFAYTN

IFEDNTMVFLAISLLFILGLCIGVGMILREFYIFRFIIGKQPYKLNINAY

>G2853_FRG STAAU8325, UNDEFINED PRODUCT 2739111:2741162
REVERSE MW: 77120
DPIVLVHGFNGFTDDINPSVLAHYWGGNKMNIRQDLEENGYKAYEASISAFGSNYD

RAVELYYYIKGGRVDYGAAHAAKYGHERYGKTYEGIYKDWKPGQKVHLVGHSMGGQTIRQ

LEELLRNGNREEIEYGKKHGGEISPLFKGNHDNMISSITTLGTPHNGTHASDLAGNEALV

RQIVFDIGKMFGNKNSRVDFGLAQWGLKQKPNESYIDYVKRVKQSNLWKSKDNGFYDLTR

EGATDLNRKTSLNPNIVYKTYTGEATHKALNSDRQKADLNMFFPFVITGNLTGKATEKEW

RENDGLVSVISSQHPFNQAYTKATDKIQKGIWQVTPTKHDWDHVDFVGQDSSDTVRTREE

LQDTWHHLADDLVKTEKTATDTKQA

LOCUS 66 (E1)
>G0406_STAAU8325, UNDEFINED PRODUCT 370166:372094 REVERSE
MW: 70979
MTTTFIISYIILALIIVGVINLFLIRSRKKGKRQQKEQQFTTRQSNQSKFKASDLDKTTD

QSTQRMTHEELRVDNQDDESQVSLNGYTKGSEKDQEAFTNNKDEEAVAAKNPESEEYKVN

EKIKKEHKNFIFGEGVSRGKILAALLFGMFIAILNQTLLNVALPKINTEFNISASTGQWL

MTGFMLVNGILIPITAYLFNKYSYRKLFLVALVLFTIGSLICAISMNFPIMMVGRVLQAI

GAGVLMPLGSIVIITIYPPEKRGAAMGTMGIAMILAPAIGPTLSGYIVQNYHWNVMFYGM

FIIGIIAILIGFVWFKLYQYTTNPKADIPGIIFSTIGFGALLYGFSEAGNKGWGSVEIET

MFAIGIIFIILFVIRELRMKSPMLNLEVLKFPTFTLTTIINMVVMLSLYGGMILLPIYLQ

NLRGFSALDSGLLLLPGSLIMGLLGPFAGKLLDTIGLKPLAIFGIAVMTYATWELTKLNM

DTPYMTIMGIYVLRSFGMAFIMMPMVTAAINALPGRLASHGNAFLNTMRQLAGSIGTAIL

VTVMTTQTTQNLSAFGEELDKTNP

>G0407_STAAU8325, UNDEFINED PRODUCT 372110:372754 REVERSE
MW: 23024
MPQKGTIAKLDGMEGSMVQAGNPIAYAYNL

DDLYVTANIDEKDIKDVEVGKDVDVTIDGQKASIKGKVDSIGKATAASFSLMPSSNSDGN

YTKVSQVIPVKITLESEPSKQVVPGMNAEVKIHKN

LOCUS 67 (F119)
>G1831 FRG_STAAU8325, UNDEFINED PRODUCT 1723090:1723806
REVERSE MW: 27770
MEHTTMKMTAIAKASLALGILATGTITSLHQTVNASEHKAKYENVTKDIFDLRDYYSGAS

KELKNVTGYRYSKGGKHYLIFDKNRKFTRVQIFGKDIERFKARKNPGLDIFVVKEAENRN

GTVFSYGGVTKKNQDAYYDYINAPRFQIKRDEGDGIATYGRVHYIYKEEISLKELDFKLR

QYLIQNF

>G1832_STAAU8325, UNDEFINED PRODUCT 1724158:1725096 REVERSE
MW: 34671
MEHTTMKITTIAKTSLALGLLTTGVITTTTQAANATTLSSTKVEAPQSTPPSTKIEAPQS

TABLE 7-continued

```
KPNATTPPSTKVEAPQQTANATTPPSTKVTTPPSTNTPQPMQSTKSDTPQSPTTKQVPTE

INPKFKDLRAYYTKPSLEFKNEIGIILKKWTTIRFMNVVPDYFIYKIALVGKDDKKYGEG

VHRNVDVFVVLEENNYNLEKYSVGGITKSNSKKVDHKAGVRITKEDNKGTISHDVSEFKI

TKEQISLKELDFKLRKQLIEKNNLYGNVGSGKIVIKMKNGGKYTFELHKKLQENRMADVI

DGTNIDNIEVNIK

>G1834_STAAU8325, UNDEFINED PRODUCT 1725193:1725327 REVERSE
MW: 5264
LFVKVAFLCLKSDETSNVPSVESHQNHFYLTNIMDFLIYLTMIQI

>G1835_STAAU8325, UNDEFINED PRODUCT 1725449:1726531 REVERSE
MW: 40775
LEHTIMKMRTIAKTSLALGLLTTGAITVTTQSVKAEKIQSTKVDKVPTLKAERLAMINIT

AGANSATTQAANTRQERTPKLEKAPNTNEEKTSASKIEKISQPKQEEQKTLNISATPAPK

QEQSQTTTESTTPKTKVTTPPSTNTPQPMQSTKSDTPQSPTIKQAQTDMTPKYEDLRAYY

TKPSFEFEKQFGFMLKPWTTVRFMNVIPNRFIYKIALVGKDEKKYKDGPYDNIDVFIVLE

DNKYQLKKYSVGGITKTNSKKVNHKVELSITKKDNQGMISRDVSEYMITKEEISLKELDF

KLRKQLIEKHNLYGNMGSGTIVIKMKNGGKYTFELHKKLQEHRMADVIDGTNIDNIEVNI

K

>G1837_STAAU8325, UNDEFINED PRODUCT 1726810:1727562 REVERSE
MW: 28926
DYDFFPFKIDKEAMSLKEIDFKLRKYLIDNYGLYGEMSTGKITVKKKYYGKYTFELDKKLQE

DRMSDVINVTD

IDRIEIKVIKA

LOCUS 68 (G27)
>G0516_STAAU8325, UNDEFINED PRODUCT 482272:486557 REVERSE
MW: 163057
VVIVLAMTEQQKFKVLADQIKISNQLDAEILNSGELTRIDVSNKNRTWEFHITLPQFLAH

EDYLLFINAIEQEFKDIANVTCRFTVTNGTNQDEHAIKYFGHCIDQTALSPKVKGQLKQK

KLIMSGKVLKVMVSNDIERNHFKLACNGSLIKAFRNCGFDIDKIIFETNDNDQEQNLASL

EAHIQEEDEQSARLATEKLEKMKAEKAKQQDNNESAVDKCQIGKPIQIENIKPIESIIEE

EPKVAIEGVIFDINLKILKSGRHIVEIKVTDYTDSLVLKMFTRKNKDDLEHFKALSVGKW

VRAQGRIEEDTFIRDLVMMMSDIEEIKKATKKDKAEEKRVEFHLHTAMSQMDGIPNIGAY

VKQAADWGHPAIAVTDHVVQAFPDAHAAAEKHGIKMIYGMEAGMLVDDGVPIAYKPQDVV

LKDATYVVFDVETTGLSNQYDKIIELAAVKVHNGEIIDKFERFSNPHERLSETIINLTHI

TDDMLVDAPEIEEVLTEFKEWVGDAIFVAHNASFDMGFIDTGYERLGFGPSTNGVIDTLE

LSRTINTEYGKNGLNFLAKKYGVELTQHHRAIYDTEATAYIFIKMVQQMKELGVLNHNEI

NKKLSNEDAYKRARPSHVTLIVQNQQGLKNLFKIVSASLVKYFYRTPRIPRSLLDEYREG

LLVGTACDEGELFTAVMQKDQSQVEKIAKYYDFIEIQPPALYQDLIDRELIRDTETLHEI

YQRLIHAGDTAGIPVIATGNAHYLFEHDGIARKILIASQPGNPLNRSTLPEAHFRTTDEM

LNEFHFLGEEKAHEIVVKNTNELAD

LOCUS 69 (H110)
>G2217 FRG_STAAU8325, UNDEFINED PRODUCT 2108154:2110211
FORWARD MW: 74420
DPASGYASILGIPTLQTGVFGGIIGALAAWCYNKFYNINLPSYLGFFAGKRFVPIMM

ATTSFILAFPMALIWPTIQSGLNAFSTGLLDSNTGVAVFLFGFIKRLLIPFGLHHIFHAP

FWFEFGSWKNAAGEIIHGDQRIFIEQIREGAHLTAGKFMQGEFPVMMFGLPAAALAIYHT

AKPENKKVVAGLMGSAALTSFLTGITEPLEFSFLFVAPLLFFIHAVLDGLSFLTLYLIDL
```

TABLE 7-continued

HLGYTFSGGFIDYFLLGILPNKTQWWLVIPVGLVYAYIYYFVFRFLIVKLKYKTPGREDK

QSQAATASATELPYAVLEAMGGKANIKHLDACITLRLRVEVNDKSKVDVPGLKLGASGVL

EVGNNMQAIFGPKSDQIKHEMQQIMNGQVVENPTTMEDDKDETVVVAEDKSATSELSHIV

HAPLTGEVTPLSEVPDQVFSEKMMGDGIAIKPSQGEVRAPFNGKVQMIFPTKHAIGLVSD

SGLELLIHIGLDTVKLNGEGFTLHVEEGQEVKQGDLLINFDLDYIRNHAKSDITPIIVTQ

GNITNDLFKQGEHGNISFGDQLFEAK

LOCUS 70
>G1778_STAAU8325, UNDEFINED PRODUCT 1669401:1669715 REVERSE
MW: 11597
MRGGGNNQQMMKQMQKMQKKNAQEQEKLKEERIVGTAGGGMVAVTVTGHKEVVDVEIKEE

AVDPDDTIMLQDLVLAATNEAMNKADELTQERLGKHTQG

>01780_STAAU8325, UNDEFINED PRODUCT 1669808:1671502 REVERSE
MW: 63481
LNYQALYRMYRPQSFEDVVGQEHVTKTLRNAISKEKQSHAYIFSGPRGTGKTSIADVFAK

AINCLNSTDGEPCNECHICKGITQGTNSDVIEIDAASNNGVDEIRNIRDKVKYAPSESKY

KVYIIDEVHMLTTGAFNALLKTLEEPPAHAIFILATTEPHKIPPTIISRAQRFDFKAISL

DQIVERLKFVADAQQIECEDEALAFIAKASEGGMRDALSIMDQAIAFGDGTLTLQDALNV

TGSVHDEALDHLFDDIVQGDVQASFKKYHQFITEGKEVNRLINDMIYFVRDTIMNKTSEK

DTEYRALMNLELDMLYQMIDLINDTLVSIRFSVNQNVHFEVLLVKLAEQIKGQPGVIANV

AEPAQIASSPNTDVLLQRMEQLEQELKTLKAQGVSVAPVQKSSKKPARGIQKSKNAFSMQ

QIAKVLDKANKADIKLLKDHWQEVIDHAKNNDKKSLVSLLQNSEPVAASEDHVLVKFEEE

IHCEIVNKDDEKRSSIESVVCNIVKNKVKVVGVPSDQWQRVRTEYLQNRKNEGDDMPKQQ

AQQTDIAQKAKDLFGEETVHVIDEE

>G1781_STAAU8325, UNDEFINED PRODUCT 1671574:1672095 REVERSE
MW: 19908
MQIYLSTLTELDYDKSLNSIEESFDDNPETSWQARAKVKHLRKSPCYNFELEVIAKNENN

DVVGHVLLIEVEINSDDKTYYGLAIASLSVHPELRGQKLGRGLVQAVEERAKAQEYSTVV

VDHCFDYFEKLGYQNAAEHDIKLESGDAPLLVKYLWDNLTDAPHGIVKFPEHFY

>G1782_STAAU8325, UNDEFINED PRODUCT 1672236:1672334 REVERSE
MW: 3948
LKTIQRIIRGTCLWEVAFLYVKFDSSELDVQFE

>01783_STAAU8325, UNDEFINED PRODUCT 1672737:1673480 REVERSE
MW: 28585
IGNDVASDSIYDYLEKVLNL

NISYSSKSITFEPFDEQAYQLFGDVSVAYSATVRSIVYLENTMPFQYNISKHLANEFKFN

DFSRRRIK

LOCUS 71
>G1083_STAAU8325, UNDEFINED PRODUCT 1057165:1058778 REVERSE
MW: 57664
DREKLQERLAKLAGGVAVIKVGAASETELKERKLRIEDALNSTRAAVEEGIVAGGGTALVNV

YQKVSEIEAEGDIETGVNIVLKALTAPVRQIAENAGLEGSVIVERLKNAEAGVGFNAATN

EWVNMLE

LOCUS 72
>02296_STAAU8325, UNDEFINED PRODUCT 2195143:2196150 REVERSE
MW: 37749
MNREMLYLNRSDIEQAGGNHSQVYVDALTEALTAHAHNDFVQPLKPYLRQDPENGHIADR

IIANPSHIGGEHAISGIKWIGSKHDNPSKRNMERASGVIILNDPETNYPIAVMEASLISS

TABLE 7-continued

MRTAAVSVIAAKHLAKKGFKDLTIIGCGLIGDKQLQSMLEQFDHIERVFVYDQFSEACAR

FVDRWQQQRPEINFIATENAKEAVSNGEVVITCTVTDQPYIEYDWLQKGAFI

>G2297_STAAU8325, UNDEFINED PRODUCT 2196150:2197127 REVERSE
MW: 35879
LIEKSQACHDSLLDSVGQTPMVQLHQLFPKHEVFAKLEYMNPGGSMKDRPAKKIIEHGIK

HGLITENTHLIESTSGNLGIALAMIAKIKGLKLTCVVDPKISPTNLKIIKSYGANVEMVE

EPDAHGGYLMTRIAKVQELLATIDDAYWINQYANELNWQSHYHGAGTEIVETIKQPIDYF

VAPVSTTGSIMGMSRKIKEVHPNAQIVAVDAKGSVIFGDKPINRELPGIGASRVPEILNR

SEINQVIHVDDYQSALGCRKLIDYEGIFAGGSTGSIIAAIEQLITSIEEGATIVTILPDR

GDRYLDLVYSDTWLEKMKSRQGVKSE

LOCUS 73
>G2599_STAAU8325, UNDEFINED PRODUCT 2484215:2486668 REVERSE
MW: 91038
DPVIGRDKEITRVIEVLSRRTKNNPVLIGEPGVGKTAIAEGLAQAIVNNEVPETLKDKRVM

SLDMGTVVAGTKYRGEFEERLKKVMEEIQQAGNVILFIDELHTLVGAGGAEGAIDASNIL

KPALARGELQCIGATTLDEYRKNIEKDAALERRFQPVQVDEPSVVDTVAILKGLRDRYEA

HHRINISDEAIEAAVKLSNRYVSDRFLPDKAIDLIDEASSKVRLKSHTTPNNLKEIEQEI

EKVKNEKDAAVHAQEFENAANLRDKQTKLEKQYEEAKNEWKNAQNGMSTSLSEEDIAEVI

AGWTGIPLTKINETESEKLLSLEDTLHERVIGQKDAVNSISKAVRRARAGLKDPKRPIGS

FIFLGPTGVGKTELARALAESMFGDDDAMIRVDMSEFMEKHAVSRLVGAPPGYVGHDDGG

QLTEKVRRKPYSVTLFDEIEKAHPDVFNILLQVLDDGHLTDTKGRTVDFRNTIIIMTSNV

GAQELQD

LOCUS 74
>G1438_STAAU8325, UNDEFINED PRODUCT 1399373:1401364 REVERSE
MW: 74364
MIGKIINERYKIVDKLGGGGMSTVYLAEDTILNIKVAIKAIFIPPREKEETLKRFEREVH

NSSQLSHQNIVSMIDVDEEDDCYYLVMEYIEGPTLSEYIESHGPLSVDTAINFTNQILDG

IKHAHDMRIVHRDIKPQNILIDSNKTLKIFDFGIAKALSETSLTQTNHVLGTVQYFSPEQ

AKGEATDECTDIYSIGIVLYEMLVGEPPFNGETAVSIAIKHIQDSVPNVTTDVRKDIPQS

LSNVILRATEKDKANRYKTIQEMKDDLSSVLHENRANEDVYELDKMKTIAVPLKKEDLAK

HISEHKSNQPKRETTQVPIVNGPAHHQQFQKPEGTVYEPKPKKKSTRKIVLLSLIFSLLM

IALVSFVAMAMFGNKYEETPDVIGKSVKEAEQIFNKNNLKLGKISRSYSDKYPENEIIKT

TPNTGERVERGDSVDVVISKGPEKVKMPNVIGLPKEEALQKLKSLGLKDVTIEKVYNNQA

PKGYIANQSVTANTEIAIHDSNIKLYESLGIKQVYVEDFEHKSFSKAKKALEEKGFKVES

KEEYSDDIDEGDVISQSPKGKSVDEGSTISFVVSKGKKSDSSDVKTTTESVDVPYTGKND

KSQKVKVYIKDKDNDGSTEKGSFDITSDQRIDIPLRIEWGKTASYIVKVDGKTVAEKEVS

YDDV

>G1439_STAAU8325, UNDEFINED PRODUCT 1401364:1402104 REVERSE
MW: 28046
DQLMQLALDNHSKDNVTFILA

AIEGDKV

LOCUS 75
>G0364_STAAU8325, UNDEFINED PRODUCT 331693:334395 REVERSE
MW: 98970
MAANFKEQSKKHFDLNGQSYTYYDLKAVEEQGITKVSNLPYSIRVLLESLLRQEDDFVIT

DDHIKALSQFGKDGNEGEVPFKPSRVILQDFTGVPAVVDLASLRKAMDDVGGDITKINPE

TABLE 7-continued

VPVDLVIDHSVQVDSYANPEALERNMKLEFERNYERYQFLNWATKAFDNYNAVPPATGIV

HQVNLEYLASVVHVRDVDGEKTAFPDTLVGTDSHTTMINGIGVLGWVGGIEAEAGMLGQ

PSYFPEPEVIGVRLVNSLPQGATATDLALRVTQELRKKGVVGKFVEFFGPGVQHLPLADR

ATIANMAPEYGATCGFFPVDDESLKYMKLTGRSDEHIALVKEYLKQNHMFFDVEKEDPNY

TDVIELDLSTVEASLSGPKRPQDLIFLSDMKSSFENSVTAPAGNQGHGLDKSEFDKKAEI

NFKDGSKATMKTGDIAIAAITSCTNTSNPYVMLGAGLVAKKAVEKGLKVPEYVKTSLAPG

SKVVTGYLRDAGLQPYLDDLGFNLVGYGCTTCIGNSG

LOCUS 76
>G2434_STAAU8325, UNDEFINED PRODUCT 2324870:2325844 REVERSE
MW: 37506
VIKFKNVTKRYGKHVAVDNISFNINEGEFFVLIGPSGCGKTTTLKMINRLIHLSEGYIYF

KDKPISDYPVYEMRWDIGYVLQQIAIFPHMTIKENIAQVPQMKKWKEKDIDKRVDELLEM

VGLEPEKYKNRKPDELSGGQRQRVGVIRALAADPPVILMDEPFSALDPISREKLQDDLIE

LQTKIKKTIIFVTHDIQEAMKLGDKICLLNEGHIEQIDTPEGFKNNPQSEFVKQFMGSHL

EDDAPCVEENA

>G2435_STAAU8325, UNDEFINED PRODUCT 2326069:2327847 REVERSE
MW: 68170
HGLMKGYTTSELSHLIDELRTKGFLNENDEI

LMCDTSIKKLLSNEVEVFTTPFKQKATEKVFINTVEGVDRVLFSQLVEVRKKLSDKLTIA

PVSIFSDYTLEEFAKRKPASKQDMINIDGVGSYKLKHYCPAFLETIQNYKAKV

LOCUS 77
>G2617_STAAU8325, UNDEFINED PRODUCT 2501985:2502917 REVERSE
MW: 34781
DRAIRSVAFFLTALPSYWIASILIIYVSVKLNILPTSGLTGP

LOCUS 78
IIAIIILIFISFFFSGSETALTAANKAKFKTEADKGDKKAKGIVKLLEKPSEFITTILIG

NNVANILLPTLVTIMALRWGISVGIASAVLTVVIILISEVIPKSVAATFPDKITRLVYPI

INICVIVFRPITLLLNKLTDSINRSLSKGQPQEHQFSKEEFKTMLAIAGHEGALNEIETS

RLEGVINFENLKVKDVDTTPRINVTAFASNATYEEVYETVMNKPYTRYPVYEGDIDNIIG

VFHSKYLLAWSNKKENQITNYSAKPLFVNEHNKAEWVLRKMTISRKHLAIVLDEFGGTEA

IVSHEDLIEELGMEIEDEMDKKEKEKLSQQQIQFQQRKNRNVSI

LOCUS 79

>G1981_STAAU8325, UNDEFINED PRODUCT 1853885:1855240 REVERSE
MW: 50053
MINVTLKQIQSWIPCEIED

>G1982_STAAU8325, UNDEFINED PRODUCT 1855258:1856436 REVERSE
NW: 44485
VILLRFKDANKSINNRTKSILIYIKVANPDISLEENEMTKENICIVFGGKSAEHEVSILT

AQNVLNAIDKDKYHVDIIYITNDGDWRKQNNITAEIKSTDELHLENGRALEISQLLKESS

SGQPYDAVFPLLHGPNGEDGTIQGLFEVLDVPYVGNGVLSAASSMDKLVMKQLFEHRGLP

QLPYISFLRSEYEKYEHNILKLVNDKLNYPVFVKPANLGSSVGISKCNNEAEKLEGIKEA

FQFDRKLVIEQGVNAREIEVAVLGNDYPEATWPGEVVKDVAFYDYKSKYKDGKVQLQIPA

DLDEDVQLTLRNMALEAFKATDCSGLVRADFFVTEDNQIYINETNAMPGFTAFSMYPKLW

ENMGLSYPELITKLIELAKERHQDKQKNKYKID

>G1983_STAAU8325, UNDEFINED PRODUCT 1856643:1857842 FORWARD
MW: 44601
MNYSSRQQPDKHWLRKVDWVLVATIAVLAIFSVLLINSAMGGGQYSANFGIRQIFYYILG

TABLE 7-continued

```
AIFAGIIMFISPKKIKHYTYLLYFLICLLLIGLLVIPESPITPIINGAKSWYTFGPISIQ

PSEFMKIILILALARVVSRHNQFTFNKSFQSDLLLFFKIIGVSLVPSILILLQNDLGTTL

VLAAIIAGVMLVSGITWRILAPIFITGIVGAMTVILGILYAPALIENLLGVQLYQMGRIN

SWLDPYTYSSGDGYHLTESLKAIGSGQLLGKYNHGEVYIPENHTDFIFSVIGEELGFIG

SVILILIFLFLIFHLIRLAAKIEDQFNKIFIVGFVTLLVFHILQNIGMTIQLLPITGIPL

PFISYGGSALWSMMTGIGIVLSIYYHEPKRYVDLYHPKSN
```

LOCUS 80

MEROZOITE SURFACE ANTIGEN
```
DHGIVFNASLPLYKDAIHQKGSMRSNDNGDDMSMMVGTVLSGFEYRAQKEKYDNLYKFFK

ENEKKYQYTGFTKEAINKTQNVGYKNEYFYITYSSRSLKEYRKYYEPLIRKNDKEFKEGM

ERARKEVNYAANTDAVATLFSTKKNFTKDNTVDDVIELSDKLYNLKNKPDKSTITIQIGK

PTINTKKAFYDDNRPIEYGVHSKDE
```

SURFACE PROTEIN
```
MGCTVKMNKINDRDLTELSSYWVYQNIDIK

KEFKVNGKRFKQVDSYNDDKNSNLNGAADIKIYELLDDKSKPTGQQTIIYQGTSNEAINP

NNPLKSSGFGDDWLQNAKLNMMDNESTDYLKQTDQLSNQYKIKLEDADRLSNSDFLKKYR

MESSNFKNKTIVADGGNSEGGAGAKYQGAKHPNEKVVATDSAMIPYAAWQKFARPRFDNM

ISFNSTNDLLTWLQDPFIKDMPGKRVNINDGVPRLDTLIDSHVGYKRKLNRKDNTYDTVP

LIKIKSVKDTEIKNGKKVKKTINITLDMDGRIPINVWTGDSIARSGRGTLIKLNLENLDA

LSKLITGETSGMLAECVIFLNESFNISENENKNFADRKKQLSEGFKDKINLFQLEEMERT

LISKINSLEEVADETIESISAVKHLLPDFALDALKERINELFKGIKSFIEKVYDSIDNEI

LEIFKNIDHDFRDGVSEEMM
```

LOCUS 81
G0745
```
 DHYVIQYFSGLIGGRGRRANLYGLFNKAIEFENSSFRGLYQFIRFIDELIERGKDFGEEN

VVGPNDNVVRMMTIHSSKGLEFPFVIYSGLSKDFNKRDLKQPVILNQQFGLGMDYFDVDK

EMAFPSLASVAYRAVAEKELVSEEMRLVYVALTRAKEQLYLIGRVKNDKSLLELEQLSIS

GEHIAVNERLTSPNPFHLIYSILSKHQSASIPDDLKFEKDIAQIEDSSRPNVNISIVYFE

DVSTETILDNDEYRSVNQLETMQNGNEDVKAQIKHQLDYRYPYVNDTKKPSKQSVSELKR

QYETEESGTSYERVRQYRIGFSTYERPKFLSEQGKRKANEIGTLMHTVMQHLPFKKERIS

EVELHQYIDGLIDKHIIEADAKKDIRMDEIMTFINSELYSIIAEAEQVYRELPFVVNQAL

VDQLPQGDEDVSIIQGMIDLIFVKDGVHYFVDYKTDAFNRRRGMTDEEIGTQLKNKYKIQ

MKYYQNTLQTILNKEVKGYLYFFKFGTLQL
```

G0746
```
MKFLSFKYNDKTSYGVKVKREDAVWDLTQVFADFAEGDFHPKTLLAGLQQNHTLDFQEQV

RKAVVAAEDSGKAEDYKISFNDIEFLPPVTPPNNVIAFGRNYKDHANELNHEVEKLYVFT

KAAS
```

LOCUS 82
G1333
```
SGTGFIVGKNTIVTNKHVVAGMEIGAHIIAHPNGEYNNGGFYKVKKIVRYSGQEDIAILH

VEDKAVHPKNRNFKDYTGILKIASEAKENERISIVGYPEPYINKFQMYESTGKVLSVKGN

MIITDAFVEPGNSGSAVFNSKYEVVGVHFGGNGPGNKSTKGYGVYFSPEIKKFIADNTDK
```

G1334
```
MNKNIIIKSIAALTILTSITGVGTTMVEGIQQTAKAENTVKQITNTNVAPYS
```

TABLE 7-continued

```
GVTWMGAGTGFVVGNHTIITNKHVTYHMKVGDEIKAHPNGFYNNGGGLYKVTKIVDYPGK

EDIAVVQVEEKSTQPKGRKFKDFTSKFNIASEAKENEPISVIGYPNPNGNKLQMYESTGK

VLSVNGNIVSSDAIIQPGSSGSPILNSKHAEIGVIYAGNKPSGESTRGFAVYFSPEIKKF

IADNLDK

LOCUS 83
G2364
MNMKKKEKHAIRKKSIGVASVLVGTLIGFGLLSSKEADASENSVTQSDSASNESKSNDSSSV

SAAPKTDD

TNVSDTKTSSNTNNGETSVAQNPAQQETTQSSSTNATTEETPVTGEATTTTTNQANTPATTQ

SSNTNAEE

LVNQTSNETTFNDTNTVSSVNSPQNSTNAENVSTTQDTSTEATPSNNESAPQSTDASNKDVV

NQAVNTSA

PRMRAFSLAAVAADAPAAGTDITNQLTNVTVGIDSGTTVYPHQAGYVKLNYGFSVPNSAVKG

DTFKITVP

KELNLNGVTSTAKVPPIMAGDQVLANGVIDSDGNVIYTFTDYVNTKDDVKATLTMPAYIDPE

NVKKTGNV

TLATGIGSTTANKTVLVDYEKYGKFYNLSIKGTIDQIDKTNNTYRQTIYVNPSGDNVIAPVL

TGNLKPNT

DSNALIDQQNTSIKVYKVDNAADLSESYFVNPENFEDVTNSVNITFPNPNQYKVEFNTPDDQ

TTTPYIVV

VNGHID

LOCUS 84
G2820
MNMKKKEKHAIRKKSIGVASVLVGTLIGFGLLSSKEADASENSVTQSDSASNESKSNDSSSV

SAAPKTDD

TNVSDTKTSSNTNNGETSVAQNPAQQETTQSSSTNATTEETPVTGEATTTTTNQANTPATTQ

SSNTNAEE

LVNQTSNETTFNDTNTVSSVNSPQNSTNAENVSTTQDTSTEATPSNNESAPQSTDASNKDVV

NQAVNTSA

PRMRAFSLAAVAADAPAAGTDITNQLTNVTVGIDSGTTVYPHQAGYVKLNYGFSVPNSAVKG

DTFKITVP

KELNLNGVTSTAKVPPIMAGDQVLANGVIDSDGNVIYTFTDYVNTKDDVKATLTMPAYIDPE

NVKKTGNV

TLATGIGSTTANKTVLVDYEKYGKFYNLSIKGTIDQIDKTNNTYRQTIYVNPSGDNVIAPVL

TGNLKPNT

DSNALIDQQNTSIKVYKVDNAADLSESYFVNPENFEDVTNSVNITFPNPNQYKVEFNTPDDQ

TTTPYIVV

VNGHID

LOCUS 85
>G0455_STAAU8325, UNDEFINED PRODUCT 416425:417609 REVERSE
MW: 43472
RYLHQHPELSFHEDETAKYIAEFYKGKDVEVETNVGP

RGIKVTIDSGKPGKTLAIRADFDALPITEDTGLSFASQNKGVMHACGHDAHTAYMLVLAE
```

TABLE 7-continued

```
TLAEMKDSFTGKVVVIHQPAEEVPPGGAKTMIENGVLDGVDHVLGVHVMSTMKTGKVYYR

PGYVQTGRAFFKLKVQGKGGHGSSPHMANDAIVAGSYFVTALQTVVSRRLSPFETGVVTI

GSFDGKGQFNVIKDVVEIEGDVRGLTDATKATIEKEIKRLSKGLEDMYGVTCTLEYNDDY

PALYNDP

LOCUS 86
>G2379_STAAU8325, UNDEFINED PRODUCT 2264977:2265987 REVERSE
MW: 37179
GSTMACVSEAILHLLPYNVFFVPARGGLGENV

VFQANTIAASMAQQAGGYYTTMYVPDNVSETTYNTLLLEPSVINTLDKIKQANVILHGIG

DALKMAHRRQSPEKVIEQLQHHQAVGEAFGYYFDTQGQIVHKVKTIGLQLEDLESKDFIF

AVAGGKSKGEAIKAYLTIAPKNTVLITDEAAAKIILE

G2378_STAAU8325, UNDEFINED PRODUCT 2263914:2264921 REVERSE
MW: 36281
MAVKVAINGFGRIGRLAFRRIQEVEGLEVVAVNDLTDDDMLAHLLKYDTMQGRFTGEVEV

VDGGFRVNGKEVKSFSEPDASKLPWKDLNIDVVLECTGFYTDKDKAQAHIEAGAKKVLIS

APATGDLKTIVFNTNHQELDGSETVVSGASCTTNSLAPVAKVLNDDFGLVEGLMTTIHAY

TG

LOCUS 87
>G1472_STAAU8325, UNDEFINED PRODUCT 1435745:1436533 REVERSE
MW: 30166
DNFKKQPHHLIYEELLQQGITLGITTRGDGLSDYPKNAFNMARYIDDR

LOCUS 88
>G2206_STAAU8325, UNDEFINED PRODUCT 2093451:2094926 REVERSE
MW: 55558
VILALPMFILLTFYLQP

LVRYIFERIVMAVIVIIGVIVSVFTILYFSPLDAAYSILGQNATKAQIHQFNVLHHLNEP

YFIQLWDTIKGVFTFDLGTTYKGNEVVTKAVGERIPITIIVAVLALMVALIIAIPIGIIS

AMKRNSWLDITLMIIALIGLSIPSFWQGLLFILAFSLKLDILPPSYMPEHPISLILPVLV

AELLGGSAVTEQVFNINGIGRYIVQKQLIPDIPAVMGGVVYISIVISLANLIIDIFYALI

DPKLRSEINERK

>G2205_STAAU8325, UNDEFINED PRODUCT 2092282:2093451 REVERSE
MW: 43439
VRHMAQLNSKIASLKLFASYAIATYILVILTSALNLFKGYVADTFYIAETLLIVLTIILI

IILTTEQTWKHHDLWRRIVEVLLLLMTLTGNVFTLLMFVSIRRYQRTSQIHSYNGWESFI

RKTTRHRIAIIGLLILVYMLTLSIVSQFTFDTTLATKNQFNALLHGPSLAYPFGTDDFGR

DLFTRVVVGTKLTFSISIISVVIAVIFGVLLGTIAGYFNHIDNLIMRILDVVFAIPSLLL

AVAIIASFGASIPNLIIALSIGNIPSFARTMRASVLEIKRMEYVDAARITGENTWNIIWR

YILPNAIAPMIVRFSLNIGVVVLTTSSLSFLGLGVAPDVAEWGNILRTGSNYLETHSNLA

IVPGVCIMFVVLAFNFIGDAVRDALDPRIH

>G2204_STAAU8325, UNDEFINED PRODUCT 2090490:2092262 REVERSE
MW: 66992
VKKIISIAIIVLALVLSGCGVPTKSEAVAQKSSKVEVGERPTIHFLGQASYENDMNIVKD

QLENAGFNVKMNIQPDYGSYRTQRQAGNYDIQIDDWMTVFGDPNYAMTALFSSTGSNSLL

KDKHVDQLLNKASTQNEADVKQTYKQIEDEVVFDKGYMAPLYGSKKNLVYDNKVLDKNSV

GLPNSRALIWQQFDYNNSRERDTRPLVMTQQDGEIPTLDPIRSIAPSVYSINMNMYTRLL

LLDENDHLTTKGSLSHDYAVNKDNKAFYFLLRDDDYFAKVVNGQARNTGERVSAEDVKFS

LDRARDKKSVPNNNTYNMHKHINDIKILKDEDIDQLRKEKDKDDKSIYDKLIKAYNVKSL
```

TABLE 7-continued

```
TTDGQKVNNKDGIYQIVKITTDQSMPREVNYLTHSSAGILSKKFVNQVNQEYPKGYDGSS

TIPANSDGKNALYASGAYIMTQKNAYQATFQRNPGFNETEKGSYGPAKIKNITLKFNGDP

NNALSELRNHSIDMLADVNQKHFDLIKSDKNLSIIRKNGRKSVFLMLNIKKGIFKTHPNL

RQAVVNAIDQDQFIKFYRGDKFKIASPITPLVDTGNEQRQDLEKVEKAINQ

>G2203_STAAU8325, UNDEFINED PRODUCT 2088446:2090449 REVERSE
MW: 74694
MVINLNDKQTKTSKEGLISVSHPLAAKIGKDVLDQGGNAMDAVIAIQLALNVVEPFASGI

GGGGYLLYYEQSTGSITAFDARETAPEHVDKQFYLDDSGEYKSFFDMTTHGKTVAVPAIP

KLFDYIHKRYAKLSLEDLINPAIELAIEGHAANWATEKYSRQQHARLTKYHETAQVFTHE

NQYWREGDWIVQPELGKTPQILREQGFNAFYKGDIAKQLVNVVKACGGTITLED

LOCUS 89
>G0815_STAAU8325, UNDEFINED PRODUCT 808746:808916 REVERSE
MW: 6481
VISANLISIGSQVSTKDQLLLPRMRYGNAYNMSAKAIHIHNDNQLNTAI

>G0816_STAAU8325, UNDEFINED PRODUCT 807493:808986 FORWARD
MW: 56448
RIAVLSWLSLCICIALALILYALPYLILGSNNWSFVLTWLPIEIKLALITTLIAL

FSTLIVILLFLHTKITKT

>G0817_STAAU8325, UNDEFINED PRODUCT 809084:809941 REVERSE
MW: 31551
VFIMSKIFVTGATGLIGIKLVQRLKEEGHEVAGFTTSENGQQKLAAVNVKAYIGDILKAD

TIDQALADFKPEIIINQITKLDNVDMAANTKVRIEGSKNLIDAAKKHDVKKVIAQSIAFM

YEPGEGLANEETSLDFNSTGDRKVTVDGVVGLEEETARMDEYVVLRFGWLYGPGTWYGKD

GMIYNQFMDGQVTLSDGVTSFVHLDDAVETSIQAIHFENGIYNVADDAPVKGSEFAEWYK

EQLGVEPNIDIQPAQPFERGVSNEKFKAQGGTLIYQTWKDGMNPIK

>G0818_STAAU8325, UNDEFINED PRODUCT 810088:810282 FORWARD
MW: 7657
MTNLNYDEDQSRKTAPRSFQFESTLLLFFIYYISIL

VADFL

LOCUS 92
>G2378_STAAU8325, UNDEFINED PRODUCT 2263914:2264921 REVERSE
MW: 36281
MAVKVAINGFGRIGRLAFRRIQEVEGLEVVAVNDLTDDDMLAHLLKYDTMQGRFTGEVEV

VDGGFRVNGKEVKSFSEPDASKLPWKDLNIDVVLECTGFYTDKDKAQAHIEAGAKKVLIS

APATGDLKTIVFNTNHQELDGSETVVSGASCTTNSLAPVAKVLNDDFGLVEGLMTTIHAY

T

>G2379_STAAU8325, UNDEFINED PRODUCT 2264977:2265987 REVERSE
MW: 37179
GSTMACVSEAIHLLPYNVFFVPARGGLGENV

VFQANTIAASMAQQAGGYYTTMYVPDNVSETTYNTLLLEPSVINTLDKIKQANVILHGIG

DALKMAHRRQSPEKVIEQLQHHQAVGEAFGYYFDTQGQIVHKVKTIGLQLEDLESKDFIF

AVAGGKSKGEAIKAYLTIAPKNTVLITDEAAAKIILE

LOCUS 93
>G2768_STAAU8325, UNDEFINED PRODUCT 2548049:2649509 FORWARD
MW: 52382
AIYQNKDGHLKRTLRVRDFLALGVGTIVSTSIFTLPGIVAA

EHAGPAVALSFLLAAIVAGLVAFTYAEMAAAMPFAGSAYSWVNVLFGEFFGWVAGWALLA

EYFIAVAFVASGFSANLRGLVKPIGIELPAALSNPFGTNGGFIDIIAAIVILLTALLLSR

GMSEAARMENILVILKVLAIILFVIVGLTAINVSNYVPFIPEHKVTATGDFGGWQGIYAG
```

TABLE 7-continued

VSMIFLAYIGFDSIAANSAEALDPQKTMPRGILGSLSVAIVLFIAVALVLVGMFHYSQYA

NNAEPVGWALRQSGHGVVAAIVQAISVIGMFTALIGMMLAGSRLLYS

LOCUS 94
>G2374_STAAU8325, UNDEFINED PRODUCT 2260182:2261696 REVERSE
MW: 56424
MAKKPTALIILDGFANRESEHGNAVKLANKPNF

>G2375_STAAU8325, UNDEFINED PRODUCT 2261702:2262559 REVERSE
MW: 30982
DQLKSVVIAYEPIWAIGTGKSSTSEDANEMCAFVRQTIADLSSKEVSEA

TRIQYGGSVKPNNIKEYMAQTDIDGALVGGASLKVEDFVQLLEGAK

LOCUS 95
>G2535_STAAU8325, UNDEFINED PRODUCT 2417067:2417516 FORWARD
MW: 16668
ILNFIFSFLASMFFCVIFDAPRKLYLSCGFVGTCGWMVYTLFFNGFNVHTIYSSFFG

SLALGLLSHYMARKQKEPAIIFMVTGIIPLVPGGLAYDATKNLVLLNFSTAINTMLEVTL

IAGAIALGLLFADQISKLIVSGFVKSFKRL

>G2537_STAAU8325, UNDEFINED PRODUCT 2417664:2419181 REVERSE
MW: 55776
LGIEYLRGEFLEMEKKNKQIDRGDLKQNLSEKFVWAIAYGSCIGWGAFILPGDWIKQSGP

IAASIGIVIGALLMILIAVSYGALVERPPVSGGAFAFSFLSFGRYVSFFSSWFLTFGYVC

VVALNATAFSLLVKFLLPDVLNNGKLYTIAGWDVYITEIIIATVLLLVFMLVTIRGASVS

GSLQYYFCVAMVIVVLLMFFGSFFGNNFALENLQPLAEPSKGWLVSIVVIVSVAPWAYVG

FDNIPQTAEEFNFAPNKTFKLIVYSLLAASLTYVVMILYTGWLSTSHQSLNGQLWLTGAV

TQTAFGYIGLGVALIAIMMGIFTGLNGFLMSSSRLLFSMGRSGIMPTMFSKLHSKYKTPY

VAIIFLVGVSLIAPWLGRTALTWIVDMSSTGVSIAYFITCLSAAKLFSYNKQSNTYAPVY

KTFAIIGSFVSFIFLALLLVPGSPAALTAPSYIALLGWLIIGLIFFVIRYPKLKNMDNDE

LSRLILNRSENEVDDMIEEPEKEKTK

G2538?
LOCUS 96
>G2914_STAAU8325, UNDEFINED PRODUCT 2799733:2801715 FORWARD
MW: 74379
DPTLRRVMNEIDKKPEKRERFITSDDAWDMMTSKTTV

VIVDTHKPELVLDENVLKNANRKVVIDH

LOCUS 97
>G0929_STAAU8325, UNDEFINED PRODUCT 926398:927756 FORWARD
MW: 50481
IGIPFAAGLINFVVLTAAASSCNSGIF

SNSRMLFGLSSQQQAPPNFSKTNKYGVPHVAIFASSALLLVAALLNYIFPDATKVFTYVT

TISTVLFLVVWGLIIIAYINYSRKNPDLHKNATYKLLGGKYMGYLIFVFFIFVFGLLFIN

VDTRRAIYFIPIWFILLAFMYLRYKRIAAKSNK

>G0930_STAAAA8325, UNDEFINED PRODUCT 927795:928619 REVERSE
NW: 32642
MRMKEDHMKNGQLKPGYNLQIATNSQFVLSYDLFQNPTDTRTLIPFLTMIQNTFGYLPEY

IVADAGYGSEQNYMAIIDDFNKTPLITYGMFIKDKTRKFKSGIFNTQNWKYDELNNEFIC

PNNKRIGFKRYAYRNDRYGFKRDFKLYECDDCSSCSLRHQCMKPNSKSNKKIMKNYNWEY

FKVQINQKLSEPETKNIYSQRKIDVEPAFGFMKAILGFTRMSVRGINKVKRELGFVLMAL

NIRKIAAQRAVHYKIHIKKADFYQIINRNQLFYIA

>G0931_STAAU8325, UNDEFINED PRODUCT 928619:929443 REVERSE
MW: 32667
MYKIYNMTQLTLPIETSVRIPQNDISRYVNEIVETIPDSEFDEFRHHRGATSYHPKMMKL

TABLE 7-continued

IILYAYTQSVFSGRRIEKLLHDSIRMMWLAQDQTPSKYTINRFRVNPNTDALIESLFIQF

HSQCLKQNLIDNNSIFIDGTKVEANANRYTFVWKKSIQNHESKLNENSKTLYRDLVEEKI

IPEIKEDGDSDLTIEEIDLIGSHLDKEIEDLNHSIENEDCAQIRKQTRKKITEIKKFKKK

FDDYSERKNKYEEQKSILKDRNSFSKTDLIMMQLL

>G0932_STAAU8325, UNDEFINED PRODUCT 930087:931841 REVERSE
MW: 63103
SVVGTTLVAETVKDLEGKDLSDKVIVTNSIDETFVPYVEKALGLITEENGITSPS

AIVGLEKGIPTVVGVEKAVKNISNNMLVTIDAAQGKIFEGYANVL

LOCUS 98
>G2804_STAAU8325, UNDEFINED PRODUCT 2682166:2682924 REVERSE
MW: 29096
MAYISLNYHSPTIGMHQNLTVILPEDQSFFNSDTTVKPLKTLMLLHGLSSDETTYMRYTS

IERYANEHKLAVIMPNVD

>G2805_STAAU8325, UNDEFINED PRODUCT 2683043:2685673 REVERSE
MW: 93576
DQTVPQEANSQVDNKTTNDANSIATNSELKNSQTLDLPQSSPQTIS

NAQGTSKPSVRTRAVRSLAVAEPVVNAADAKGTNVNDKVTASNFKLEKTTFDPNQSGNTF

MAANFTVTDKVKSGDYFTAKLPDSLTGNGDVDYSNSNNTMPIADIKSTNGDVVAKATYDI

LTKTYTFVFTDYVNNKENINGQFSLPLFTDRAKAPKSGTYDANINIADEMFNNKITYNYS

SPIAGIDKPNGANISSQIIGVDTASGQNTYKQTVFVNPKQRVLGNTWVYIKGYQDKIEES

SGKVSATDTKLRIFEVNDTSKLSDSYYADPNDSNLKEVTDQFKNRIYYEHPNVASIKFGD

ITKTYVVLVEGHYDNTGKNLKTQVIQENVDPVTNRDYSIFGWNNENVVRYGGGSADGDSA

VNPKDPTPGPPVDPEPSPDPEPEPTPDPEPSPDPEPEPSPDPDPDSDSDSDSGSDSDSGS

DSDSESDSDSDSDSDSDSDSESDSDSESDSESDSDSDSDSDSDSDSDSDSDSDSDSDSDS

DSDSDSDSDSDSDSDSDSDSDSDSDSDSDSDSDSDSDSDSDSDSDSDSDSDSDSDSDSDS

DSDSDSDSDSDSDSDSDSDSDSDSDSDSDSDSDSDSDSDSDSDSDSDSDSDSDSDSDSDS

DSDSDSDSDSDSDSDSDSDSDSDSRVTPPNNEQKAPSNPKGEVNHSNKVSKQHKTDALPE

TGDKSENTNATLFGAMMALLGSLLLFRKRKQDHKEKA

LOCUS 99
>G2284_STAAU8325, UNDEFINED PRODUCT 2182330:2183307 REVERSE
MW: 37252
VEDLERVLITGGAGFIGSHLVDDLQQDYDVYVLDNYRTGKRENIKSLADDHVFELDIREY

DAVEQIMKTYQFDYVIHLAALVSVAESVEKPILSQEINVVATLRLLEIIK

>G2285_STAAU8325, UNDEFINED PRODUCT 2183380:2183499 REVERSE
MW: 4917
MHQLKALLVLTHPRYYKTSQKHHYLIYLNKNSQSYLILFL

>G2286_STAAU8325, UNDEFINED PRODUCT 2183646:2184428 REVERSE
MW: 27575
IFMTNNKVALVTGGAQGIGFKIAERLVEDGFKVAVVDFNEEGAKAAALKLSSDGTKAIA

IKADVSNRDDVFNAVRQTAAQFGDFHVMVNNAGLGPTTPIDTITEEQFKTVYGVNVAGVL

WGIQAAHEQFKKFNHGGKIINATSQAGVEGNPGLSLYCSTKFAVRGLTQVAAQDLASEGI

TVNAFAPGIVQTPMMESIAVATAEEAGKPEAWGWEQFTSQIALGRVSQPEDVSNVVSFLA

GKDSDYITGQTIIVDGGMRFR

LOCUS 100
>G1465_STAAU8325, UNDEFINED PRODUCT 1429687:1432446 REVERSE
MW: 105241
VKKMDYKETLLMPKTDFPMRGGLPNKEPQIQEKWDAEDQYHKALEKNKGNETFILHDGPP

YANGNLHMGHALNKILKDFIVRYKTMQGFYAPYVPGWDTHGLPIEQALTKKGVDRKKMST

TABLE 7-continued

```
AEFREKCKEFALEQIELQKKDFRRLGVRGDFNDPYITLKPEYEAAQIRIFGEMADKGLIY

KGKKPVYWSPSSESSLAEAEIEYHDKRSASIYVAFDVKDDKGVVDADAKFIIWTTTPWTI

PSNVAITVHPELKYGQYNVNGEKYIIAEALSDAVAEALDWDKASIKLEKEYTGKELEYVV

AQHPFLDRESLVINGDHVTTDAGTGCVHTAPGHGEDDYIVGQKYELPVISPIDDKGVFTE

EGGQFEGMFYDKANKAVTDLLTEKGALLKLDFITHSYPHDWRTKKPVIFRATPQWFASIS

KVRQDILDAIENTNFKVNWGKTRIYNMVRDRGEWVISRQRVWGVPLPVFYAENGEIIMTK

ETVNHVADLFAEHGSNIWFEREAKDLLPEGFTHPGSPNGTFTKETDIMDVWFDSGSSHRG

VLETRPELSFPADMYLEGSDQYRGWFNSSITTSVATRGVSPYKFLLSHGFVMDGEGKKMS

KSLGNVIVPDQVVKQGADIARLWVSSTDYLADVRISDEILKQTSDVYRKIRNTLRFMLG

NINDFNPDTDSIPESELLEVDRYLLNRLREFTASTINNYENFDYLNIYQEVQNFINVELS

NFYLDYGKDILYIEQRDSHIRRSMQTVLYQILVDMTKLLAPILVHTAEEVWSHTPHVKEE

SVHLADMPKVVEVD

LOCUS 101 (GF7)
>G1243_STAAU8325, UNDEFINED PRODUCT 1200372:1201841 FORWARD
MW: 54782
DQVQGSLEIIYSLQEELKEITGMDEVTLQPAAGAHGEWTALMIFKAYHENNGEGHRDEVIVP

DSAHGTNPASA

SFAGFKSVTVKSNERGEVDIDDLKRVVNENTAAIMLTNPNTLGIFEKNIMEIREIVHNAG

GLLYYDGANLNAIMDKVRPGDMGFDAVHLNLHKTFTGPHGGGGPGSGPVGVVKELASYLP

KPMVIKDGDKFKYDNDIKNSIGRVKPFYGNFGIYLRAYTYIRTMGATGLKEVSEAAVLNA

NYIKARLSKHFEIPYKQYCKHEFVLSGVRQKEFGVRTLDMAKRLLDFGVHPPTIYFPLNV

EEGMMIEPTETESKETLDYFIDTLISIAEEEAKNDPDKVLEAPHTTVIDRLDEATAARKPI

LKFENLKQEK

LOCUS 102
>G2529 FRG_STAAU8325, UNDEFINED PRODUCT 2410504:2411484
REVERSE MW: 36804
LIKSGKARAHTNIALIKYWGKKDEALIIPMNNSISVTLEKFYTETKVTFNDQLTQD

>G2530_STAAU8325, UNDEFINED PRODUCT 2411492:2412409 REVERSE
MW: 32919
MTRKGYGESTGKIILIGEHAVTFGEPAIAVPFNAGKIKVLIEALESGNYSSIKSDVYDGM

LYDAPDHLDSLVNRFVELNNITEPLAVTIQTNLPPSRGLGSSAAVAVAFVRASYDFLGKS

LTKEELIEKANWAEQIAHGKPSGIDTQTIVSGKPVWFQKGHAETLKTLSLDGYMVVIDTG

VKGSTRQAVEDVHKLCEDPQYMSHVKHIGKLVLRASDVIEHHNFEALADIFNECHADLKA

LTVSHDKIEQLMKIGKENGAIAGKLTGAGRGGSMLLLAKDLPTAKNIVKAVEKAGAAHTW

IENLGG

>G2531 FRG_STAAU8325, UNDEFINED PRODUCT 2412999:2413832
REVERSE MW: 31735
NAIVRNSGGLGVVLDQGVLNISLMFKGQTETTIDEAFTV

MYLLISKMFENENVDIDTMEIEHSYCPGKFDLSIDGKKFAGISQRRVRGGIAVQIYLCVE

GSGSERALMMQTFYEHALKGEVTKFKYPEIEPSCMASLETLLNKTITVQDVMFLLLYAIK

DLGGVLNMTPITQEEWQRYDTYFDKMIERNKKMIDQMQ

LOCUS 103 (GF11)
>G2235 FRG_STAAU8325, UNDEFINED PRODUCT 2133494:2134471
REVERSE MW: 36941
VTMKRLSIIVIIGIFIITGCDWQRTSKERSKNAQNQQVIKIGYLPITHSANLMMTKKLLS

QYNHPKYKLELVKFNNWPDLMDALNSGRIDGASTLIELAMKSKQKGSNIKAVALGHHEGN
```

TABLE 7-continued

```
VIMGQKGMHLNEFNNNGDDYHFGIPHRYSTHYLLLEELRKQLKIKPGHFSYHEMSPAEMP

AALSEHRITGYSVAEPFGALGEKLGKGKTLKHGDDVIPDAYCCVLVLRGELLDQHKDVAQ

AFVQDYKKSGFKMND

>G2236_STAAU8325, UNDEFINED PRODUCT 2134482:2135219 REVERSE
MW: 28095
MIKIQQLQHHFGSHKVIHNFNLDISKGEIVTFIGKSGCGKSTLLNIIGGFIHPSSGRVII

DNEIKQQPSPDCLMLFQHHNLLPWKTINDNIRIGLQQKISDEEINAQLKLVDLEDRGKHF

PEQLSGGMKQRVALCRAHVHKPNVILMDEPLGALDAFTRYKLQDQLVQLKHKTQSTIILV

THDIDEAIYLSDRIVLLGEGCNIISQYEITASHPRSRNDSHLLKIRNEIMETFALNHHQV

EPEYYL

LOCUS 104 (GF12)
>G2828 FRG_STAAU8325, UNDEFINED PRODUCT 2715541:2717115
REVERSE MW: 59929
VKMMPRKFRVLQIGGDDLEPIFQHKKGVSWDYFDIGLFEFDSGYVEAIEAIVEAEGRFDF

IYIQAPYSETLTNLLQMISEPYNTYVDESFWSVEYEQDENVQKYVVQPLHYRNIEERNNK

LEAVSFSGQYGDKVSPKLALVHPNFKGDVVYQGNSELTLSGEFGKEFKPIASWQNNLVYD

KDKVIQIWPEFDIDGAVELQYTFRLIQTGADGALIEQIVLTDDMLDSPLEIPAKPFDAYI

SVTVKARGNGTVHLGPIHKRWSRLDMGQFLLGGSRFVDSQRQEFIYYFHPGDMKPPLNVY

FSGYRTAEGFEGYYMMKRMNAPFLLIGD

>G2829 FRG_STAAU8325, UNDEFINED PRODUCT 2717099:2718649
REVERSE MW: 61259
DQDDIIAVKTIHAEHDVVEALRTLRLVIDMSKEPDLYLQISAISAGIPQINGQQTDYVSDYD

NGRIINTVDELDDALNYYLFYLKNWNYAYAYSLKLIDAYASKNIINQLDELIEGENDAT

LOCUS 105 (E18)
>G2912_FRG STAAU8325, UNDEFINED PRODUCT 2797518:2798504
FORWARD MW: 37832
SKSYDERFTPDEVVAYQQHQGNKFKEHFDLNCYLTLLDVLDSHNIDRGRTDVTHVFKNLETK

VLTMGFIDDLLYPDD

LOCUS 106 (E101)
>G1083 FRG_STAAU8325, UNDEFINED PRODUCT 1057165:1058778
REVERSE MW: 57664
DREKLQERLAKLAGGVAVIKVGAASETELKERKLRIEDALNSTRAAVEEGIVAGGGTALVNV

YQKVSEIEAEGDIETGVNIVLKALTAPVRQIAENAGLEGSVIVERLKNAEPGVGFNAATN

EWVNMLE

LOCUS 107 (E110)
>G0975_STAAU8325, UNDEFINED PRODUCT 975981:977042 REVERSE
MW: 40300
MKLQTTYPSNNYPIYVEHGAIDHISTYIDQFDQSFILIDEHVNQYFADKFDDILSYENVH

KVIIPAGEKTKTFEQYQETLEYILSHHVTRNTAIIAVGGGATGDFAGFIAATLLRGVHFI

QVPTTILAHDSSVGGKVGINSKQGKNLIGAFYRPTAVIYDLVFLKTLPFEQILSGYAEVY

KHALLNGESATQDIEQHFKDREILQSLNGMDKYIAKGIETKLDIVIADEKEQGVRKFLNL

GHTFGHAVEYYHKIPHGHAVMVGIIYQFIVANALFDSKHDINHYIQYLIQLGYPLDMITD

LDFETLYQYMLSDKKNDKQGVQMVLIRQFGDIVVQHVDQLTLQHACEQLKTYFK

LOCUS 108 (E125)
>G2809_STAAU8325, UNDEFINED PRODUCT 2689308:2690324 REVERSE
MW: 38103
VKIMTEIQKPYDLKGRSLLKESDFTKAEFEGLIDFAITLKEYKKNGIKHHYLSGKNIALL

FEKNSTRTRAAFTVASIDLGAHPEFLGKNDIQLGKKESVEDTAKVLGRMFDGIEFRGFSQ

QAVEDLAKFSGVPVWNGLTDDWHPTQMLADFMTIKENFGYLEGINLTYVGDGRNNIAHSL
```

TABLE 7-continued

```
MVAGAMLGVNVRICTPKSLNPKEAYVDIAKEKASQYGGSVMITDNIAEAVENTDAIYTDV

WVSMGEESEFEQRINLLKDYQVNQQMFDLTGKDSTIFLHCLPAFHDTNTLYGQEIYEKYG

LAEMEVTDQIFRSEHSKVFDQAENRMHTIKAVMAATLGS

>G2810_STAAU8325, UNDEFINED PRODUCT 2690351:2691583 REVERSE
MW: 46915
DRDCPFNIEGGDELVLSKDVLAIGVSERTSAQAIEKLAPRIFENPQATFKKVVAIEIPTSRT

FMHLDTVFTMIDYDKFTMHSAILKAEGNMNIFIIEYDDVNKDIAIKQSSHLKDTLEDVLGID

DIQFIPTGNGDVIDGAREQWNDGSNTLCIRPGVVVTYDRNYVSNDLLRQKGIKVIEISGSEL

VRGRGGPRCMSQPLFREDI

LOCUS 109 (F101)
>G1098 FRG_STAAU8325, UNDEFINED PRODUCT 1068360:1069841
REVERSE MW: 57928
MTEWTREERYQRIEDVDTEYFKTLKQQVDQSKFRQQFHIQPETGLLNDPNGLIFYKGKYY

VSHQWFPLGAVHGLKYWYNYTSDDLINFKAEGPILNPKTKYDSHGVYSGSAFEYNGHLYY

MYTGNHRDNHWQRHALQMIARLKEDGSVEKFPKPVISQQPEGYTSHFRDPKVFKYDEKKY

AIIGAQNNDQQGRLLLYNTEDIINWHYLGEINTELDDFGYMWECPDYFNVDNQDVILICP

QGI

>G1099_STAAU8325, UNDEFINED PRODUCT 1069993:1070940 REVERSE
MW: 35500
MKNISDIAKLAGVSKSTVSRFLNNGSVSKKTSEKLTRIIAEHDYQPNQFAQSLRARQTHL

IGAIIPRMNSYAVDETIKGLAKQCQKYESQLILNYTGLNIEAEIQALETLARSKVDGIVL

MATDITERHIEVINKMNVPIVIVGQQHEQLHSIVHDDYKAGQIIGEWIGQQGYQQVEVFS

VSEKDIAVGIHRKRGLLDQLAKYQIKPNIHETNFTYVEAQKDVANVLENVEQVDAVVGAT

DTIALAAYKYYSDKKDVMKPHQIYGFGGDPMTQLVSPSIKTIHYNYFEAGQCAMEEIQQM

LKKQDMPYSVTVDVNI

>G1100_STAAU8325, UNDEFINED PRODUCT 1071126:1072409 REVERSE
MW: 46849
LSDYYEKKGVVSMNLNDTIFMFLCTLLVWLMTPGLSLFYGGLVQSKNALNTVMQSMAAIV

LVTFVWITVGFTISFGNGNLWFGNWEYTFLNHVGFATQEDISPHIPFALFMLFQMMFCTI

AISILSGSIAEKMKFIPYLLFVVIWTALVYSPVAHWVWGGGWINKLGVLDFAGGTVVHIT

SGVSGLVLAIMIGKGNKHSESTPHNLIITLIGGIFVWIGWYGFNVGSAFTFDNIAMLAFT

NTVISASAGAIGWLIIEYIFKKTTSLLGLLLGALAGLVVITPAAGYVTYLSATIMALIGG

ICCYIVINYIKVKLKYHDALDAFGIHGVGGIIGAVLTAVFQSKKANPDIENGFIYTGDIH

IILVQILCVTAVVIFSIVMTFIIAKVIKLITPLSVTEQETNIGLDKIVHGEHAYFEGELN

RFNKHIRY

>G1101_STAAU8325, UNDEFINED PRODUCT 1072584:1072829 REVERSE
MW: 9040
VIGKGEIIMIHELGTVGMVCPFPLIEAQKKMATLQSGDELKIDFDCTQATEAIPNWAAEN

GYPVTNYEQIDNASWTITIQKV

LOCUS 110 (F113)
>G1446_STAAU8325, UNDEFINED PRODUCT 1408055:1410469 REVERSE
MW: 92806
VAIMIAKVIVDVASKSVDYKFDYIIPEQLESVIQPGVRVIVPFGPRTIQGYVMEVTAEPD

AQLDVSKLKKIIEVKDIQPELTSELIALSEWMGSTHVIKRISMLEVMLPSAIKAKYKKAP

KMKDDIELPSALLQKFDKHGYYYYKDAQKNNDIQLLMKLLKDDIVEEKTILTQNITKKTK

RAVRVIEGYHPDEVLAKLEKVIKQYDLYAYLSEEQHKTIFLTDIEDMGFSKSSLDGLIKK

GYVEKYDAVVERD
```

TABLE 7-continued

```
LOCUS 111
G2820
>G2820_STAAU8325, UNDEFINED PRODUCT 2704341:2706197 FORWARD
MW: 69253
MPKNKILIYLLSTTLVLPTLVSPTAYADTPQKDTTAKTTSHDSKKSNDDETSKDTTSKDI

DKADKNNTSNQDNNDKKFKTIDDSTSDSNNIIDFIYKNLPQTNINQLLTKNKYDDNYSLT

TLIQNLFNLNSDISDYEQPRNGEKSTNDSNKNSDNSIKNDTDTQSSKQDKADNQKAPKSN

NTKPSTSNKQPNSPKPTQPNQSNSQPASDDKANQKSSSKDNQSMSDSALDSILDQYSEDA

KKTQKDYASQSKKDKNEKSNTKNPQLPTQDELKHKSKPAQSFNNDVNQKDTRATSLFETD

PSISNNDDSGQFNVVDSKDTRQFVKSIAKDAHRIGQDNDIYASVMIAQAILESDSGRSAL

AKSPNHNLFGIKGAFEGNSVPFNTLEADGNQLYSINAGFRKYPSTKESLKDYSDLIKNGI

DGNRTIYKPTWKSEADSYKDATSHLSKTYATDPNYAKKLNSIIKHYQLTQFDDERMPDLD

KYERSIKDYDDSSDEFKPFREVSDSMPYPHGQCTWYVYNRMKQFGTSISGDLGDAHNWNN

RAQYRDYQVSHTPKRHAAVVFEAGQFGADQHYGHVAFVEKVNSDGSIVISESNVKGLGII

SHRTINAAAAEELSYITGK

G2821
>G2821_STAAU8325, UNDEFINED PRODUCT 2706470:2707033 REVERSE
MW: 20989
SDDKHDFIIEQILSRSCDIESVESWKSSL

LOCUS 112
>G1905_STAAU8325, UNDEFINED PRODUCT 1786046:1787398 REVERSE
MW: 48776
MKDEQLYYFEKSPVFKAMMHFSLPMMIGTLLSVIYGILNIYFIGFLEDSHMISAISLTLP

VFAILMGLGNLFGVGAGTYISRLLGAKDYSKSKFVSSFSIYGGIALGLIVILVTLPFSDQ

IAAILGARGETLALTSNYLKVMFLSAPFVILFFILEQFARAIGAPMVSMIGMLASVGLNI

>G1906_STAAU8325, UNDEFINED PRODUCT 1787508:1787924 REVERSE
MW: 16172
QGHTLGYLYAHQQDGLTQNDIAKALQRT

GPTVSNLLRNLERKKLIYRYVDAQDTRRKNIGLTTSGIKLVEAFTSIFDEMEQTLVSQLS

EEENEQMKANLTKMLSSLQ

LOCUS 113
G1111
>G1111_STAAU8325, UNDEFINED PRODUCT 1083909:1085690 FORWARD
MW: 65093
DPSEINKVIHVDLGIIADCKRFLECLNDKNVETIEHSDWVKHCQNNKQKHPFKLGEEDQVFC

KPQQTIEYIGKITNGEAIVTTDVGQHQMWAAQFYPFKNHGQWVTSGGLGTMGFGIPSSIGAK

LANPDKTVVCFVGDGGFQ

MTNQEMALLPEYGLDVKIVLINNGTLGMVKQWQDKFFNQRFSHSVFNGQPDFMKMAEAYG

VKGFLIDKPEQLEEQLDAAFAYQGPALIEVRISPTEAVTPMVPSGKSNHEMEGL

G1112
>G1112_STAAU8325, UNDEFINED PRODUCT 1085693:1085944 FORWARD
MW: 9621
MTRILKLQVADQVSTLNRITSAFVRLQYNIDTLHVTHSEQPGINSMEIQVDIQDDTSLHI

LIKKLKQQINVLTVECYDLVDNEA

G1113
>G1113_STAAU8325, UNDEFINED PRODUCT 1086069:1087085 FORWARD
MW: 37588
LEEFIMTT

LOCUS 114
G1542
>G1542 STAAU8325, UNDEFINED PRODUCT 1495403:1497337 FORWARD
MW: 72192
APNSRPIDFEMKKKDGTQQFYHYASSVKPARVIFTDSKPEIELGLQSGQFWRKFEVYEGDKK
```

TABLE 7-continued

LPIKLVSYDTVKDYAYIRFSVSNGTKAVKIVSSTHFNNKEEKYDYTLMEFAQPIYNSADKFK

TEEDYKAEKLLAPYKKAKTLERQVYELNKIQDKLPEKLKAEYKKKLEDTKKALDEQVKSAIT

EFQNVQPTNEKMTDLQDTKYVVYESVENNE

SMMDTFVKHPIKTGMLNGKKYMVMETTNDDYWKDFMVEGQRVRTISKDAKNNTRTIIFPY

VEGKTLYDAIVKVHVKTIDYDGQYHVRIVDKEAFTKANTDKSNKKEQQDNSAKKEATPAT

PSKPTPSPVEKESQKQDSQKDDNKQLPSVEKENDASSESGKDKTPATKPTKGEVESSSTT

PTKVVSTTQNVAKPTTASSKTTKDVVQTSAGSSEAKDSAPLQKANIKNTNDGHTQSQNNK

NTQENKAKSLPQTGEESNKDMTLPLMALLALSSIVAFVLPRKRKN

G1543
>G1543_STAAU8325, UNDEFINED PRODUCT 1497540:1497668 REVERSE
MW: 4973
MAVPKRRTSKTRKNKRRTHFKISVPGMTECPNCGRIQIITPCM

G1544
>G1544_STAAU8325, UNDEFINED PRODUCT 1497751:1497846 REVERSE
MW: 3849
MSLLNSKQQDDSESRQVDPRKQKLQQLYDKEQ

G1546
>NONE, UNDEFINED PRODUCT 1497815:1498165 REVERSE MW: 12767
DQDDVDEHYHIIKDGMVNLQDIVEDIVIIEKPMRAYSEQSDQMLTVGNGWEVIDEDQLDELA

KQQATR

LOCUS 115
G2712
>NONE, UNDEFINED PRODUCT 2598712:2601288 REVERSE MW: 94980
EVGDRYYNRTIIYTVYLNYNVDFKRRQYTLAKFLYKMGTFIAKHKWSAVIAWIVIVAAIL

IPLATNAPKFDNDIKMTGLESLDTNKKIEKHFNQDSEKAQIRVVFKTTKDDGIVQPNITK

DIKKTLDDIKKDDKHIDKISK

G2713
>G2713_STAAU8325, UNDEFINED PRODUCT 2601346:2601891 FORWARD
MW: 21879
MKETDLRVIKTKKALSSSLLQLLEQQLFQTITVNQICDNALVHRTTFYKHFYDKYDLLEY

LFNQLTKDYFARDISDRLNHPFQTMSDTINNKEDLREIAEFQEEDAEFNKVLKNVCIKIM

HNDIKNNRDRIDIDSDIPDNLIFYIYDSLIEGFIHWIKDEKIDWPGEDIDNIFHRLINIK

TK

G2714
>G2714_STAAU8325, UNDEFINED PRODUCT 2601974:2602138 REVERSE
MW: 6456
VRYVISIIMGIVLAIWSFKQLSQSHKDSGFIFFFIVYVLCISCFNSDKHDKNKKR

G2715
>G2715_STAAU8325, UNDEFINED PRODUCT 2602253:2603800 REVERSE
MW: 57130
GSRATGTRIYERSAVVQEGQNFLKRVIAEMGGKDAIVVDEN

IDTDMAAEAIVTSAFGFSGQKCSACSRAIVHKDVYDEVLEKSIKLTKELTLGNTVDNTYM

GPVINKKQFDKIKNYIEIGKEEGKLEQGGGTDDSKGYFVEPTIISGLKSKDRIMQEEIFG

PVVGFVKVNDFDEAIEVANDTDYGLTGAVITNNREHWIKAVNEFDVGNLYLNRGCTSAVV

GYHPFGGFKMSGTDAKTGSPDYLLHFLEQKVVSEMF

TABLE 9 DNA SEQUENCES STAPHYLOCCOCUS EPIDERMIDIS
GATCGCCTTTACCTGAAACTGTTCCAGCCACTTGATTATATGTGCCCCAAGGTACTGTGTGT

AATTTAACACCAGGTTTGACGTTGTATGTTTGATTGATTTTTACAGGTGATTAGCTGTGTT

GTAAATGACCTCATCTTGTTTTACCCAACCATAATTTGTACCAGTATTATAATCACCAACAA

GATAGAATTTTTTATCACCAAGTGTGGCAGCTTTCGTCACTGACAATGTACGTTGGATTTGA

TABLE 7-continued

```
TTTGTTGTCTTTCCTTTAGTGTCATAAACTGTAGTATATAAGCCACTATTTTTTGCATTGAT
TTGAGCAACACCACTATTGTTAGTCACTGTTAATTGGTTGTTTGTTGAAGGTTTAGTTGGAT
TGCTAGGTTTAGATGCTGTAGTTAAGTAATATTTACTAATCCAACCAGATTTACC
ATTCACTGTACCATAAAGATACGTTGCTTTATCAATTTGTTGCTGTTTAGTTGCTTTAAA
TGTTTGATTTCCAGTACCAGATACTTTGCTAGCAACTTGTTTTGGTGTACCCCAAGGAAC
TGTGTAAAGTGTTGACCCTGCTTTAACATTATATGTTTGATTCACTTTTACTGGTGCCTT
AGCAGTGTTATAAACAACATCACCTTGTTTAACCCAACCGTATTTTTTACCGCTATTGTA
GTCTTCAACTAAATAGAATTTGTTATTTCCTAATGTTGCAGTTTTAGTAACGGATAGAGT
TTTTTGTACTTGATCAGTCTTATGACCTTTACTGTCATAAACAGTTGTATATAAGCCATT
ATTTGTTGGTTTAATTTGACCAACACCACGATTAGCAGACACAGTTAACTTATTATTAGT
TCCTCCTGATGGTTTAGAAGGTTGTGACGGTTTTGTAGATGTTGTGCCCCAAGGTGCTAC
TTGCTTCGTTTTAATTAAATATTTTTCATAAATTAAGTCATATAATTCTGCATAGCTATA
ATTGTGACTTCTTAAATATTGGTGAGGGTCAGCGTGATCAGTACCTCCTAAGAAGTTAGA
GATAGCAGCATGTGTCCAAACTGTTCCTCTTCCATCGTTTTCAGCGCTATCAGGTTTTAA
ATTATAATATTGCAATTGCGTTGCAGCATAATCAGCGTAGTTGTTCATTGAACGTGCAAA
TGAATCATAATCATGTGTATGGACGATTTCAACATTGATAAAACGTTGATTTCCATATGG
ACCTGCACCCCAAGATAAGTAATCTGTCGGAGCTGTTTCTATAATTCTATTGCCATCAAC
AAATGCGTGTACGAATGCATTTGTGTAATTACGTTTCATGAAAGCAATCTCGCCATCGAT
TGTTGAGTTATCATTTGCAGTATCATGAACAACGATACCTTCAGGACGTCCCACACCGTT
TCTATAGCCATATTTAGGGAAATATGACGTATAATCTTCTTCAATTCTTGGTGCTTTCAT
ATTCTTTTTACGAATATAGTTATTTATTGAAGAATTAACCTTTGGTGTATATTTCGGTAA
TGATGATGTTTTTTGACTAGATACAGAATAAACTGTTCTCGGTTGAGCAGTTGCACTAAA
TGGGGTGAATTGCTTTGTATCTATAGTCGCTTGATTAGATGCCGTTTCTTTTTTTACAGT
ATTAGTTGTTACACGTTGAGCTGGTTCTTTATATTTATATGAAGTAGTTTGTTTAGATGT
AGCATTCACATTGTTTAATGAGATAGCTCTAAATGGTCTGTTGAGCTATCATCGTCTTC
ATCATCGTAATCAAAATTATAACCAGATGCGTTTGTATTTGATACTTTAGGTGTAGCAGT
TTCATTTTGTTCAGAAGTTACTTGCTGACTTTTTTGTTGGCTTTCATTATCATTAGAAGC
AGTTTGAGTTTCAATTGCTTGATTTTCGGAAGGTTGACTTGCAGTCATCTTCTTGTCTTG
TTGTTCATTATTTGCGTTAGCTCCTAAATCTTTCTCATTTTCTTTTGCTACAGATTGTGT
CTCCTGTAATTGATTTGTATCAGTGGATGTTTTATCTTCTTGTGTCAAATCATTTGTTTC
TTCTTGTTGATTTTTTGTAACAGAATTCGTTTGATTTTGATTCGCATCATCTGTTGATAA
AGATTGTTGCTTTTGATTTGATGAAATTTCATTATAAGTACTCATTTCATCTAATGATGC
ATCATATGTAGTACTTTGTGTGTCTTGTTTAGGTTGAACTTGGGTAGGGTCTTGATATGT
TTGTGTACCAGATACATTTGTAGTTGATTGTGTAACTTCGCTTTTAGCTTTTTCTGCTTG
TTTGAGGGCAGTTTGATC
LOCUS 2
GATCATATATTATGACGTAACCTTCATCATCTATTTCAGCTATATCTCCAGT
TTGAAAATACCCATCATTATCAAATGTGTCTTTTAAATATTTGGGATATAAATAACCATT
CATCACATTTTCACCTTTAATTAATAACTCTCCATGTCCATATGCGTTGGGATTTTTTAT
TTTCACTTCGACATTTTCACTTGGTTTTCCAACAGTATCGAAACGTTCTTTGAGCATTTG
```

TABLE 7-continued

```
AGGTGAGGCTGTTAGAAACTGAGAGCAAGTTTCTGTCATACCAAAAGAATTATATACAGG
TAAACGATAAGTCAATGCTTGCTCAATTAATTGTGGTGATAATTTAGCACCACCTAGCAG
AATTTTTTCTAAAGAAAATGGTTGAGTCAATCCTGCATCCATTAACCACTTTAACGTTTG
TGGAACAAGGGACATATGGGTGATTGGATAAGTCTTTATTTGTGTTAACATATCATCAGT
TTGAAACTTTTTAACAAGTCTGACAGTGAATCCTTCTATCACTGCGCGCAAAATAACACT
GAGCCCAGAAATATGATATATAGGTAAGACCGAAAGCCACACAGTATTTTGTTCGAATCC
TAAACTTTGTTTACAGCCTTTAGCACTGGCTAAATGATTATTAAACGTTTGAGGCACAGC
TTTTTGAGGTCCCGTCGTTCCAGACGTAAACATAATTGATGCAATCGATTCTAAATTAAA
TTTGTAACCTGAAACATCATGTTTATCTAATTGTGTTAAATCATTAAAATGATATAAATT
AAACCCTTCTAATTCTAAAGGCAACGTGTGTACAATCGTTGCTATGTCGACTGAATTCAT
TTGATTTATCATCTCATGTCGCGTTAAACGTGTATTTATCATAGCTATTTCAATATGAGC
TAACCAACAAGCATGAATCAAAACAACTGAATCAATATCATTGCTTATATATAAACCAAT
CCTTTTCTGATTTAAAGAAGTTAAATATTCCGCGATTGTTTTTGCACGATGATATAATTC
TTCGTACGTTAAAGATAACTGATTTGTAACAATCGCTAATCGATTTCCATTTGATTGAGC
TTGTTCCTGTAACCAAAAATTCACAATGCATTCCTCCAAATTATATACACGTATAATTAT
ACCTACTTGCTTATTAAATATCAGTAGTTGAGCTTAATATGTTATTTTCAACTTAAAGTA
ATACGTCCAAAAGTCAATCCCCTATTGAAAATGTGGACTACATGCGTCAACTATAAGTCT
TTAATGTAATCATGCTTTTAAGTTAGTAACCTACGCAACTTTCATTATCACATTTCAATT
AATAATGTGCTCTATTTATTTTCATCAATCATTCTATTATTAACTATATATACATTTTTA
TAAGAATCGTTCTCTTTTCAAAAAGAATCACCTCATGAATTCATTATTTAATATATTTTA
TTTATATAATATTGTAACACCGTTTAGTTTGTTATATTTTTAAATTACTTTATATAACAC
TATGGGTTTTATATGAGTACCGAAATTGTTAAATACTTTTTCCGAGATATTTCACCGAA
TAATAAACTATAGATTGAAGGGAAATAGATGAAGCTACAAAACTCACTCATTCTAACATT
CCAATAGGAATAAAGAGAATTTAAACTGTAACTGATAATGTTTAATGTTACTAAATTAAC
AGAATAAAACTTCGTAATGAAAACAATCAAATTATCACTTATATTACACCTGATGTTAC
TGAAGATGAAATGAGAGAAATTATAGCTTTTATGGATTAATAAAAACAAAGAAAAATAG
CGATAAATAAAGAGAGACGCTTATATTACTAATTTACACTTTAGTATGATTACGTCTCTT
TTTTATATATAAAATTACGCATAATTTAAACCTTCATATAGGAGTTGATTTTATAAAATAT
AATCAATATGCAATTTCTAAAACTAAATAAGGAGTGAGAATTATGCATCAATATAAGGAG
TTGATTGATGATATAGATATTAAATATATTGAAATGCCAAATAAATTAGAATGAGTCATT
TTAGGTAGTGAATTATATGTTAACAGTAAATTATCATCAAGTTCTTATGTGAGAGAAGAC
ATCAACACTTACTATGTACTATGTGAAAAGTAATTTAACTAACGCACTAATCTCTTTAAA
TCAAATTGAAAAAGCAATCAACGCTCACGATTGCAAAACACTTCAAGACTTGAGTAATTA
CTTTAACTTACCTACTACACATTTATTTCTAACAATGTGATTCTATAACCTTAAATATAC
AAATTTGCTTTTTTCAATATATTAAAAATTAAACCTGCTACTTTTCATCAAATAGATACA
CAGGAGGACGTTTTATGCAACAAGAAACGACATCATGGTACAAACAAGAATGGTTTATAG
TTTTATCACTTTTATTCATTTTTCCACTAGGTTTATTTCTCATGTGGAAATTTAGCAAGT
GGCCATCTATTGCAAGAACAATCATTACTGTTGCAATTTCAGTTATCGTATTAGCAAGCA
TTACCTATTATGGTAATCTACAAATGATTGTACCAGCAACATCAAATTCAAATAACGAAA
CTAAAGAAACTACAGAGAATAATGTAAATGATAAAGACGAGCGAAATCATAAAACTGCAG
```

TABLE 7-continued

```
TAGAAGAAACAAAAACTAATTATGACTCCACCAAAGAAAATACTAAAGAACCTGGAAAAG
AAAATGAATCTGCAACACGATTGGAGAACTCTGCGTCTTGAAAGGCAAAGTCATATTATG
ATGATTTTCACATGTCTAAACTAGGAATTTATGATATTTTAACATCTGAATATGGAGAAA
AATTTGATAAAGAAGATGCACAATATGCTATAGATC
LOCUS 3:
GATCTTATCTGATAATTTGACACTTA
AGTCAACATCGCTTGGTAAAACATCTGATGCAGCTGGAATGAGTAACACGTCGTCGAATG
TTAAAGATTCTTTAGCAAATTTATTTTCCCACATTAAAAACAGCCTCCAATTTTATTTAT
ACTTAGTTACATTATTTCACATTTTCTTCAGTTTGTTTATACTTTATACCATTAAAAAAG
AAATTTAAGATGATTGCAGAAATTGCGCCAAGCACTATACCATTTTGAGTTAACCAAGCA
AATTGTTCTCCTAATCCTTTAAATGCTTGAGGTACTGCACTAATACCAGCACCTAACCCT
ACTGAAATTGCAATAATTAATAAATTATTTTGATTTTGGAAATTAATGTTACCCAAAATA
CTAACGCCGTATGCCATAACCATTCCAAACATTGCTATCATTGCTCCACCTAAAACCGGC
AATGGAATAATATTAGCTAAAGCACCTAATTTAGGTATACAACCGCAAATTAGTAAAAGA
ATAACCATTCCATATATCACATTGTTCTTTTAGCTCCTGATAAAGAAACAAGACCTACA
TTTTGGGAATATGCAGTGTAAGGGAACGCATTAAATATTGAACCTAAAATGATTGCTAGA
CCTTCCGCAGTGTACCCTTTTCGAAAATCTTTTCTTTCTAGTTTTCTACCAGTAATTTCA
CTCAGTGCATGATAGACACCAGTAGATTCAATTAAACTTACAACTGCAACAATGAAAAT
ACAAGTATTGAGCTGACATCAAATCCGAAGCCAGAAAATCTGAATGGCACAGGGAAACCA
AACCAATGTGCATCACCCACTTGTTTGATATCAACCATTCCAAATATACCAGCTAAAGCA
GTACCTATTGCTAATCCTATAAGTATCGCAATTGATTTCAAGAAGCCCTTTGTAAATCTT
TGCAAAATAAGAATAATGAGTAGTGTAACACCACCTAATATTAAATTCTTAGTATCGCCA
TAGTTTTTCGCTCCTTCACCACCTGCCAAGTAATTCATTGCAACTGGCATTAAATTGATT
CCAATAATTGTCACAACACTTCCTGTTACAACAGGTGGAAAGAATTTAACTAAATAAGAG
AAAAAAGGTGCAATTAAAACAACTAAGATACCGGATATTAAAAGCGAACCATATAAAACA
TCAAGTCCTTTCGTTTGACCGATGAGTATCATAGGTGCAACGGCAGTAAACGTACATCCT
AGTACAATCGGTAATCCAGTCCCTGTGACTTTATTTGCTTGAAGAAATGTCGCTACCCCG
CACATAAATATATCAACAGTAACTAGATAAGCAATTTCTTCAGCTGAAAATTTTAAGCTT
GTCCCCACAATAATAGGAACAAGAATAGCCCCTGCATACATCGCTAACAAATGTTGCACA
CTTAATATGAAATTTTTCATTACGCTTCACCTAAAAGAGTTACCTTATTGCCTTTTAATG
AAGCTACCTTACAAAGTGAAGATACATATAAGCCTGCATCTTCTAAACGTTGGCGACCAT
TTTGGAAACTTTTTTCAACCACAATACCCACGCCAACTGTCGTCGCATTTGCTTGTTTTA
CAATGTCATTAAGACCTAGCGAAGCATCACCATTAGCTAAAAAGTCATCAATGATAAGTA
CTTTATCGTCTGCACCTAAAAATTCTTCAGATACAATGACTGTACTCGTTTTATTTTTTG
TAAATGAATGAATATCCGTGCTATAAAAGCCATCTTTCAAAGTACTAGGTTTAGCTTTTT
TAGCAAATAGACAAGGAACATCAAAATGAAAAGAAGCCATAATAGCAGGCGCAATACCAG
AAGCTTCAATAGTTAAAATTTAGTAATACCAGCGTCTTTGAAAGACTCATAAAATGTTT
TACCTACATCATTCATCAACTTTGCATCAATTTGATGATTTAAAAATCCATCTACCTTCA
AAATTTTCTCATCGATGACAACGCCATCTTCTTTGACTTTTCGTCCTAACGACTCCACTC
```

TABLE 7-continued

AAAAAACCTCCTCAAGTAAATTCAAATTCGATTCCTAGATACAAAAAAACCTCAAACTAC

CATTAATAGTTTCAGGATC

LOCUS 4:
GATCCTGGTAAAGCGATTATGACAATTAAATAAAGCCT

ATAAGAATAACTTAATGGCTAAAACAAATAAGTCTGGGACAAGGATATATTATGTCCCAG

ACTTTCTTTATGTATATACAGATTCTTATGAGATGAGTCCAACACAGAGAATTTCCGAAG

AAATTCCACGGACAAAGCAAGTTGGGGTTGGGGAGAAGACAGGGGACAATGAATTCTATC

CTAGTTTAGCGTTCATTTTAATAAGGGGAATTTTACAAAGTTGACAAGCGTGATAATTAT

AGGCAATGTTGATATTGGACATATCATTTTAAAGAGAAAGGAAAGATGGTAATCATGGAT

GACTTGAAACAAAATCAATCTTCTAACGAAAAACCTAAAGGTAATAAAATAATTAATATT

TTGATATTCATCGGAATGATTTTATTAATTCAAATACCTATTGGCGTGTCACTAATAGCT

TTACCTTTTTCAGTGAAATTCAGTAAGTTAACATCCATCGCATTAAGTATGCTAATAACT

GGTACAGCACTATTAATCATATGGTTAGTTAGGAATTATTATTTGAGTCATACATATGAA

AGACAATATCAATCAATGAGGGGAAAAGATATCTTTATTAATATTGGTTTTCTGGTATTA

TCAATGGTTTTTAGTATTCTAAGTAGTGTATTAATGGTCATATTTACTGGCAACGATACT

ACAGCGAATGAGAAAGAAATCAATGAAAGTTTAGATTTACTTTTACAAAAAGACCATTTA

CCACATATTTCAATTGTTGCAACTGTTGTTTTAATGATATGTATTATAGGTCCGTATTTA

GAGGAATTACTCTTCCGAGGAATTTTTAAAGAAACATTATTTATGAAATATCGATTTTGG

CTACCATTCATTATATCTTCTATTATTTTTAGTTCACAACATTTATCAACAAATATATTT

TCATATGCAATTTATTTTCTAATGGGTTGTGTATTATACCTTGCCTATAACAGAAGACGT

AATATCAAAGATAGTATGATGGTTCACATGTTGAATAATTCTGTTTCAACATTACCGGTA

TTGTTGGTTATTTATGGCTATATTTTTAGATAGTAAACATAACAATAAAGACCTGATTAA

AAGTAGATTTATCTTTTAATCAGGTCAATTTTATATGTTAAATTGTGATATCATTCTCTA

TGATTAATTTAATCGCTTTATGATCTGTTGCATTTCTAAATAAATCATAGGCACTTTCGA

TTTCACTCAGTTTACTATAATGTGTCACGAGTTGTTCTGGTTGTATTATTTTGCTTTTTA

ACGCTTCAAGTAATTCTTCAGTTGTATTTCCTGAAACTAAACCAGTAGTTACGTTAATAT

TTTTAATCCATAATTTATCTATATCAAGTTGTACAGGTAACCCATGCACACCAACATTAG

CAATCGTACCATCGACACCAATTAAATTTTGACATAAATCAAAGGTTTGTGGAATTCCCA

CAGCTTCAATAGCAACATCAACACCACGTGGATTTAACGATTTTACCTTTTTAATTGCGG

TTTCAGTCTCTTTAGAGTTAATTAAATGCGTAGCACCTAGTTCTTTAGCGGTTTCTAATC

TATTATCATCTAAATCAATCATAATAATTTTTGAAGGTGAATAGAATTGTGCTGTAAGTA

ATGCTGCTAAACCTACAGGACCAGCACCTACAATGGCTACTGTACAGCCAGGTTTAACTT

TACCTTTTAAAACACCAATTTCATAACCTGTTGGAAGTATATCTGATAACATTACAAGGG

CGTCTTCTTTTAAATTTGAAGGGGCGTGATATAAAGAATTATCTGCAAAAGGAACTTTAA

CATATTCTGCTTGAGTACCATTCACTAAATGTCCTAATATCCATCCTCCTCCGTTTTCAC

AATGTGCATAGATACCTTTTTTGCAATAGTAGCATTTGCCACATGATGAAATGCAAGAGA

TAATCACTTTATCTCCAACTTTCAAGTTGTTAACGTTGTCACCAATTTCTTCAATGATTC

CAATACCTTCGTGACCTAGTGTCGTATGTGATTTAACTTCAGGTGTATCTCCTTTTATGA

TATGAAGATC

TABLE 7-continued

```
LOCUS 5:
GATCAATTACTTGTTAATATATTACAACCA

TACGAACAACACATAAAACAAGAAAATCGTACACTTGAAGTTAATTTCTGCACAGATATT

GATGCATTCTACCAGTATCGACCTCCAATCGAACGTATTTTGACCAATTTACTAGATAAT

GCATTAAAATTTTCTAATTCTGGTAGCCGTATTGATATTATTATTTCTGAGTGTAAAGAA

AACGACGTCATTAGTATTTCAATAAAAGATGAGGGCATAGGTATCGTTCCAGAACTTCAA

TCACGTATCTTTGAAAGAACGTTTAGAGTTGAAGATTCTCGAAATACTAAGACTGGTGGT

TCGGGGTTAGGATTATACATTGCAAATGAGTTAGCACAACAAATTGACGCCTCTATTACA

GTCCAAAGTGATTTAGACATTGGAACCACGATGACACTTACCTTAAAAAAATTTCAATTT

AAAAAGTAATTTGTATTGCATTAAAAAACCGAATGTAGCTGGAATGAGTTTGAACACTCT

AGCTACATTCGGTTTTCATTAATGTACACGCTCTTTAAAACCTTCATCTTGAGAATAATT

TGATGCATACGTATCACTATATGTTTTAACTTTATAAAAAGAACTTAATTTATATAAATC

ATTACTACGCTTGTTGTTTCTATTTTTATTCAGGTTTAAAGCATTATATCTCATGTCGAG

ATTCTCAGTCTGAATATTAGAGTTTTCAACAATATACTTCGGTCTATGTTTAACTTCATA

ATAAATACGACCAATATATTCTCCTACTACGCCAATAGACATTAATTGAATACCACCCAA

CAATAATATAGCAGCAATCGTAGTAAAATAACCAGGTATATTTATACCATTAATCAAAAT

ATTTATTAATAAATAAATTATATATAAAATACTGATAGAAAACGTGAACATACCTAAGTA

TATCATCATGCGTAAAGGGTTATTGTTAAAAGAGATGAGTCCATCAATACCATAGTTGAG

TAACTTTCTAAAAGTCCACTTAGATTCTCCATCTTCACGCGTCACATTTTCATATTGAAA

TACTTTTGTTTCATAACCTATCCATTCAAATAGACCCTTAGAGAAACGATTATATTCATC

AAGTGTTGTTAAAGCTTGAACTGCACGTCGACTGAGTAATCTAAAATCACCAACGCCGTC

TTCAAATTGGATATCCTCTACAAATGCATTAATTAATTTATAATAACAACGAGACAAAGT

TTTACGTACAAAATTCTCTCCCTGACGATTTCTCTTAGCAACCACTTGATCATAACCTTC

AATGTAACCCTCTATCATTTGTGGAATATATTCAGGCGGATGTTGTAAATCTCCATCAAT

CATAATCACCGCGTCGTGCATTGTGCTATGCTGATAGCCAGCAATCATTGCAGCTTCTTT

GCCAAAGTTTCGACTGAATGAAAGATATTTAACATGGTTATCATACGCAACAATATTCTT

GATATGATGTATTGTCGTATCTGTACTACCATCGTTAATAAAGAGTAAATCGTATTCATA

ATTTTTGATTAAACTATCTTTCTTCATTATTTCAGTTAATTTGTCATAAGTTTTCAAAAC

GACTTCGCCTTCATTATAGCAAGGGACGATGACTCTGATTTTCATTAAATGACATCCTTT

TCTCTGAACTATTTGCTATCATTTTATCAATTTCCTTGTCATACATTCTAGTTAAATACT

GTGTATTTACATAATCTTAAATTAAGCTTAATAGTTTTAAATATTTTCTTTTATGAGCAT

CACATTAACTTTTAGTAAAAAGAATTTAATTATTTTTTAAAGTTAACTCTAACTGATTA

ATTATATTTATTTCAAATCTCCAATACTGACATCATCAGGATC

LOCUS 6:
GATCAGTTGATTGGTGTGTCGATTGTGACATTA

TAATAACTCCTTTTCTATATTAAATAATTAGGTAATAAAAATTTTACAACACTATAAAGA

ATTACAAAAGTATTTAAGTTCATAAATTCTAAATATATAGAAGTTTTAGAAAACTCATTA

CATTGAACTTTACTTTATTACAATTTATCTAATAAATATTAAGAAAAGTAACGAAATATG

TCTTATAAATAGCGATATATCAACTTTCTTTAATAAATGTTCAGAACAATACATTATTTT

AACAATGTTACAAGATAATAACAAAGCCCACAAAGTCAAATATTTTGTTAGTATGGGGT

ACGTAATAAAAAAACAAAAAGTTAATGTACAGAGACTTGTCGGGACAATTATCTAAATCA
```

TABLE 7-continued

```
TTAAACTTAAATCAATTAAATCTTTGTTATATTTAAGGAGGAGTTACTTTGAAAAAGTTA
GCCTTTGCAATTACAGCCGCTTCAGGCGCAGCAGCAGTTCTATCACATCATGATGCTGAA
GCTTCTACACAACATAACCTTCAATCTGGAGAATCCTTATGGACTATTGCACAACAATAC
AATACTTCAGTAGAAAGCATTAAGCAGAATAATAATCTTAGCAACAATATGGTATTCCCA
GGACAAGTTATTAATGTAGGTGGAAGTGCTTCACAAAATACTAGTTCAAACACTTCTTCA
AGTTCAGCATCTTCACATACTGTAGTAGCAGGTGAATCATTAAACATCATAGCTAATAAA
TATGGTGTTTCAGTTGATGCATTAATGCAAGCAAATCATCTAAATGGTTATTTAATTATG
CCTAACCAAATATTAACTATCCCTAATGGTGCTTCTGCTTCAGGATCAGGTGGTACAGCA
ACTCAAACTAGCGGTAATTATACTTCACCTTCATTCAACCATCAAAACTTATACACTGAA
GGTCAATGCACATGGTATGTGTTCGACAAACGTTCACAAGCTGGTAAACCTATCAGTACT
TACTGGTCTGATGCAAAATACTGGGCGTCAAATGCAGCGAATGATGGTTATCAAGTTGAT
AATACTCCATCTGTTGGTGCAATTATGCAAAGTACACCTGGACCATATGGTCATGTAGCA
TACGTTGAACGTATTAATGGTGATGGTAGTATTTTAATTTCAGAAATGAATTATGCAAAT
GGTCCATACAATATGAACTATCGTACTATCCCAGCTTCAGAAGTATCTTCATATGCATTT
ATCCACTAATCATTGATGATTAATGATTTTACTACAAGGTAATGGAATATACCTTGTAGT
TTTTTATTTTAATAGAATGATTGAACCTCATTATTTTATATTTTAAGCAATTCAAATAAA
AAGGCCACACAAAGTTGACTAAAAATGTCAGTCTTTGTGTGGCCTTTAGCTATATGTACT
TACGTATTATACAAACCTTTTTTATTTTAAGAACAGATGAATAATAAAATAAATAATTGC
TGCTAAAACAGCTGAGATAGGTAAAGTAATCACCCATGTTACAACCATACGTTGAGCAGT
ACTCCATTTAACACCTTTCGCACGATTTGAAGCACCTACACCTAGAATAGATGAAGACAC
AACGTGTGTAGTAGATAATGGGAAATGTAATGATGACGCTACGAAAATCGTTAATGCTGA
AGAAATATCAGCGGCTGCACCGTTAGCAGGTCTAATTTTCATAATATTTCCGCCAACAGT
TTTGATGATTTTCCAACCACCTACTGCTGTACCTAATCCCATAGCTGTTGCACACGCAAC
TTTAACCCATACTTGAGGTTCAACATTACTACCATCTTGTAAATTACCTACAATTAAAGC
TAATGTGATAATACCCATAGATTTTTGAGCATCGTTTGTACCATGTGAGAATGATTGTAA
TGCTGCAGTAAAGATTTGGAAAAACCTAAAATTACGATTAGTACGTGTTAAATTTGAATT
TTTAAAAACGATTTTAACAATCGTATACATCATATAACCTACACAAAAGCTATAATTGG
TGAAATGATTAATACGATAATAATTTTTGTAAAACCTTGATAGTGTAATACTGCAAACGA
ACCTTGCGATGCAATGGCTGCACCCGCTATAGATC
LOCUS 7:
GATCATATTATTAGAGCTTAT
CACAAGTTTTTGCAAAGTGGTTACCAAACAGAATTACATTTATTTGGTAGAGATGAAGAT
AATCAAATTCCATTGATGAATACTTTGATTTCAGAATTAAAATTATCGGATAAAGTTAAA
ATATTTAAATATACCAATCAACCTTTACAAGAATTTAAGAATTCTAAAGCCTCTCTACTT
ACAAGTCAATATGAGGGATTTGGCTTAACACTTATGGAAAGTATAGAAATGGGGTGTCCA
GTCCTATCTTATAACGTTCGTTACGGTCCAAGTGAAATTATTCAAAACGGGATAAATGGC
TATCTCATTGAAAAAATGATATTGATAGTTTATCAAAACATATGATTAACATCATTGAG
CACCCACTACAAAAAGTGAAAAATAAAGACACTTTAAAATATAACGCCGCAGTGAATAAT
TACAAACAACTTATGCAAAGCTTAGACTTATTAAAATAGTCAAGTTTTCCGATATTATAA
AGATTTGGTAGCATCTTTATAAAACTATAATTAAGCCCATTGATGATTCTTAATCCAATC
```

TABLE 7-continued

```
ATCAATGGGCTTAATTTGATAGTTATATATTGTTAAACAATTTTCTTAATGAATAAATTT

GTAATTTCTCACTTGATAAGCTGGAATTGTTCTATATGTCATATTTCCAGGAGCTGCACT

CCAGTTCATTTCTGAAACTAAAATACTTCCATCGCTATTCACGCGCTCTACAAACGCTAC

GTGACCATAGTAACCAGCGTCAGTTTGTGCAATTGAGCCTACTGTAGGACGATAATCAAT

AGTATATCCATCAGCAGCTGATGCATTGTCCCAATTATTTGCATTCCACCAGTATGTACT

GATACCTTTTCCTATTTCAGCACGTGTATTAAATACGTGCCATGTGCATTGTCCCCAAGT

ATACAAGTTTTGATGGTTAAAAGTTGGTGAATAATAGCCACCGTTTGATCTAGTATTATT

AGAAGATGAGCTACTAGAACTACCTCCAGGCACTTTTAACTTCTGTCCAGGATAGATAAA

GAAATTAGTTAATCCATTTAATTGCATAATTTTTTGATACGTTGTCCCATATTTACTAGC

AATTGCAGATAGTGAGTCTCCATACTTAACAGTATATGTTGCAGTACGACCACTAGACCC

ACTAGCTTTTGCACGACTGGAACTCGTCGCTTTACCAGAAACTTTCAACTTTTGTCCAGG

GAAAATAAGATAGTTATTTAACCCATTAAGTTGCATGATTTTTTGATAAGTTGTACCGTA

TTTTGCAGCAATAGAAGATAATGAATCTCCAGCTTTAACTGTATAAACTGTGCCACTATT

TGTTGACGTTGCTCTTGAAGATGAGCCTGATACTTTCAATACTTGATTAGGGAATATTAA

ATTGGAAGTCAATCCATTAAGTGATTTTAATTTAGCAATACTAATCCCATATTTGTGAGA

AATTGACCATACAGATTCTCCACTTTTTACTGTATGCGTTGTTGCAGCTTGTGCATGAGT

TGATGCCAATGCGCTAAGGGCAGTTGTTCCAATAATGGCAGTAATATATTTTTTTGCAC

TTGAAATCCTCCTCTACTTTAGGTTTTGTTTATTCGCGTTTTAACAATACAAAGATATTA

TACTCTTTAATTATGTATAGCATGTTTGCTTTAGATGACATTCTGATTACAAATATTATT

TTAAATAAAAAATAGGGCTACGCTCAAACATATTTGCATTTATCCAATTTAATACATTTT

GCAGTCAATTACAATGTCTTTTTATCACAATTATTATTAATATGGTTTCGCACCTTATA

TTTACAATTTCGAATGTAATGTTTTTTCTATTTTCAAATTAATATTAAATGGACAGACGC

TTATTTCTAGATTCTAAATGCAACATTTCGAATAAAAAAAGAAGTAGGAATAGAATTCGC

TATGAATTCTTTATCCCACTTCAAAAAGGTAAAATGCCATGAAAGATATAGAAATATATC

TTCAACTTAGTCATTGACTATAAAATTGTTTTGCAACCATCACATATAACTGGAATTCTA

GACTAAAAATTTCTATATGGTGAATGTTGCGCTAAAACTTTATATTATTTTTTTGCCAAC

TCATTTTCGATTTCTTCGATTTCCTTTTTAGAAAGATC
```

LOCUS 8:
```
GATCAATTCAGAGAAGCAATGACAAAATTC

CCAGTTTGGATGGGTGCTACTACCCTATTCTTCGGTGCCATAAATGGTGCTAAAGAAATG

CTTGATGTAATTACTGAAATTGATGGAAAAATGATTACTCTTGCAAAAGTTACTGGTGAT

GACAATGCACTTCAACAAACATTTATTGACGCAAATAATGCTGCTTCTCAATTCGGACAG

ACATTAGGAAGCGTATTAGATGTATATGCAGAATTCGCTAGACAAGGTGTTAAAGGTAAT

GAGTTATCTCAATTCTCAAATGCAGCATTAATTGCTGCTAACGTTGGTGAGATTGACGCT

AAACAAGCTTCTGAATATTTAACTTCTATGTCTGCTCAGTGGGAAACGACTGGAAACCAA

GCTATGAGACAAGTTGACTCACTCAACGAAGTTTCCAATAAATATGCTACAACTGTTGAA

AAGTTAGCACAAGGTCAAGCAAAAGCTGGCTCTACTGCTAAATCAATCGGACTTACTTTT

GATGAAACTAATGGTATTATTGGTGCATTAACAGCTAAGACTAAGCAATCTGGGGACGAA

ATTGGTAACTTTATGAAAGCCACTTTACCTAAACTTTATAGTGGTAAAGGTAAATCAACT

ATTGAAGGCTTAGGCATTAGTATGAAAGATGAAAATGGACAATTAAAATCTGCCATTTCT
```

TABLE 7-continued

```
CTTTTAGAAGAAGTTTCTCAGAAAACTAAAAACTTAGAAAAAGACCAAAAAGCCGCTGTT
ATAAATGGCTTGGGTGGAACATACCACTACCAACGTATGCAAGTATTATTAGATGATTTA
TCTAAAACAGATGGCTTATATAAACAAATTAAAGAAAGTTCCGAAAGTTCAGCTGGCTCT
GCATTACAAGAGAATGCAAAATACATGGAGTCAATTGAAGCTAAAGTTAACCAAGCAAAA
ACAGCATTCGAACAATTCGCATTAGCTGTTGGTGAAACATTTGCTAAATCAGGAATGCTT
GATGGTATCAGAATGGTTACTCAACTTTTAACTGGTTTAACTCATGGAATTACTGAATTA
GGCACAACTGCTCCGATTTTCGGCATGGTTGGTGGTGCTGCCTCATTAATGAGTAAGAAT
GTTAGAAGTGGTTTTGAAGGTGCTAGAAGTAGTGTTGCTAATTATATTACTGAGGTAAAT
AAATTAGCTAAAGTTAACAATGCTGCTGGTCAAGTTGTTGGACTTCAAAAAGTTCAAACT
GGTACAGCTTCACAACTTCAGTTTAATAAAAATGGTGAATATGATAAAGCTGCTTCACAA
GCAAAGGCTGCTGAACAAGCAACTTACCAATTCTCTAAAGCTCAAAAAGATGTATCAGCT
AGTGCTATGATCGCTTCAGGTGCAATCAACAAAACAACTGTGGCTACCACAGCAAGCACT
GTTGCCACTCGTGCTGCTACACTTGCAGTTAATGGTTTAAAATTAGCCTTTAGAGGCTTG
TTGGCTGCTACTGGTGTCGGGTTAGCAATAACTGGTGTTTCTTTTGTACTGGAAAAAGTT
GTAGGTAGTTTTAATGCTGCAAGTCAAGCTGCTGAACAATATAAACAAAAACAAGAGCAA
ACGAAGCAAGCAATAGCTTCTATGAGTAATGGTGAAATTAATTCACTTATTAGTAGTTAC
GATAAACTACAACAAAAATGAATTCTGGTAGTGCATTTAATACAGCGGAAGCTGAGAAA
TATAAAGAAGTAACAAGTCAATTAGCTAATATATTCCCCGATTTAGTTACTGGTGAAAAC
CGTTATGGTAAGGAAATGGCCGGTAATAAAGAAGTAATGAAACAGAAAATTGAGTTAATC
AAGCAAGAAATGGAGCTTGAAAGACAAAAGAATGCTATCAAACAAkAAGAAGAGCAAGAC
GCTTACATCAAAGAACAAGATAGCTTAGCTAAGAAAAACAGAGGTCAAAAATGGTATCAA
CTTGGTCAAACACCAGAGTTGAAACTTCAGGAACAAGCACGTCCTACTACTGTTTCTGAT
AATAGTAACATTAACAAAATTAATGCCACTATCCAAAAAGTGAAGAGTCAAGCCCAAGCT
GAAAAAGCATTAGAACAAGTTGATAAGCAACTTGCTCAATCTCAAACTAAGAATAGACAA
AATGAAGTTCAGCACTTACAAAAAGTTAGACAAGCTTTACAAGATTATATTACTAAAACT
GGTCAAGCAAATCAGGCAACAAGAGCTGCGGTATTAACTGCACAGCAACAATTCACTAAC
CAGATAGCAACAkTGAAAAAGCTTGGTACTACTGGTCAACAAGTGATGACTACTATTTCT
AACTCAGTTGCGAAAACAGCAAAGTCTGGTAAAGCTGCTCAAGCAACCTTCAAGTCGTTT
GAAACCTCATTAGTTAAAAGCTCTTCATTCAAAAGCAAGATGGCTAGTTATGAAGCTTCT
GTTAAGAAATTTAAAAATGCTGCTAACCAATCTGCTAAAATTGCTGCTCTTAAAGACGTA
GAACGTGATTACTCTAAAGTTGCTAAAGGTATTATGCAAGCGGCAAAAGCGGCAAACATG
AGTAAATCTCAAATGAAAGATTTGAAAAAATCTCTTCAACAAAATATACAAGCAGAAACA
GCCTTTAGAGCTTCAGTAAGTAAAGCTGGTAAAGTTACTATTGATCAATCTAAGAAAATC
AAACAGAATA
```

LOCUS 9:
```
GATCAATTTTCAAATCGCCTAGTCCTAGCGCTCATCATTGTATACTCAGTT
ATGTCGTTGTGTCCCGTTCTAACATTTGCTTTTTAGTAATAATGGGGTACTTTTTGAAAA
CAATAGACCCTACAATACCAGCAATAGTTCCTATAATCGCCATAACCACACCATAGATAA
TCACTTTCGTTAAACTATTAAAACCAAACATCACTAAAAAACCTGCAATAGGTGTAGCAG
TGCCAGTTGCATTATTAATCATACCTGACCAAGCAATTATAATACCGGCAATTGCCCCAC
```

TABLE 7-continued

```
CAAAGAAATTAGTGACATAAATAGGAATAGGATTAGCGGAAACAATATCAGCTTGAGAAA
GCGGTTCGATTCCGACTGAAATGGTTGATTTACGGTCTCCCAATTTCAAACGATGGAACA
ATGCACTATTCATAAACGCGGAACTAAATGCGGCCATGGCACCTATAGCCATAGGCGCAC
CCGTTAAACCAAGCAATGCAGTGAGAGCCATTGAACTTAATGGAGCAGTACCTACTACTG
TAATAATACCTCCCAATACAATTCCCATAATCAACGGGTTAGCATCTGTACTACTTTGTA
TAATATCCCCAATTTTAATTAACGTGTTATTAACCACTGGCGTCAATCCAGTAGCAATTA
ACCTAGCTATAGGTGCGAGAAGAATGATTGAACCAATTAAATCAATACCGTCTGGCACAT
ATTTCTCGGTATACTTCATCATGTAGCCTACAATATACCCAGCGAAAAATCCTGGTAACA
AGTCCATACCTCCACAAGCTGCCCCAATAACTAGTGCATAAACTGGAGATACCCCAATCG
CTAATGCAGTTAATCCAGCCGCAGCCACACCACCTAAACCTCCAGCACCATCTCCCAGTT
CTTCTAAGAATTTAATCCCAAATACTTGACCACCCACATATTTATTGAAAGCTTCAACTA
AAAACGATGCAATCGCCGCATTCGCTAAAGCTCCCATCGCCCTCATCCCACTAGGTGCTT
TGTATGTAAATAGAGTAAAAATAACTAAAACTAAAATTAAAAATAAAGTACCTATAAGCA
AATCCATATCAAACACTCCCCATAACACTTATAATTTTCTGATTTTTAGAAAACAACTA
TAAAATACATAGTACCAAAAAAATATACCTTTGAGGAGAATTTTTTAAAAAATAGAAAAT
ATTTATTAAATTAAATAAAGTTAAATAGTAAAAATTGTGACAAGCTTCAACTTACTCTAC
CAATGGAGACATTTATTAGAATTCCTCAAATTAATCCTCCACGACATATTAATGAAATGA
TTGAAACGATACACAATCGTGATTTTGATGAATTCAGTTCTCTAAAAAGAACAATTTAAA
TTTTTAATAAATCAATCATAAATATCACCTTTTTTCAAAGCAAGATTTGTATTTGCGAGT
TCTTCCATAAATTGTGAGTCATTTAAAACATCGAATGGTTTATTACCTTCGCCTATTAAA
AATCTAAAATGAGTAATATTCATAAATTCAAATATTAATTTAAATTGGTGGACTAAAGGT
TGTGCTTTGATACGTGGACTGTCACCGCCTATGATTAAAATTAAGTTTTTTTGTGACAT
AATTTCTTTGAAGTTATCTATTTGCGTATCTCGCAATGATTCAGTCCATCTATCAATAAA
GAGTTTTAAAGACGCACTCATGGAATACCAATAGAGAGGCGTTGAGAAAATTATAATATC
TGATTTTAAAACTTTATTTAAAATTTTTTTATAATCATCATTATGAATGCTAGTTTCATT
GCTATGACGATTATCATTAACCTTTTCAATGTTACTTTGGTATAAATTTATAAACTTTCC
ATCAATTAGTACATTTTATTATTATCAATAGGTTTTAAAAATCCAAAGTTAAGTAGTTGA
ACTAGACCTAAAAAGACATAAATAAAAAATCAAGATC
LOCUS 10:
TTGATCCGATAACTACGCCAATGATTGTAAGTATGACAAGTGCTCGATTAGGTA
AATGTTTGTGATTCAATTGACTTAACCAAGAAGGGAGTAAACCATCTCGTCCAAATGAAT
ATAATAGACGTGAACCTGCAAGCATCATACCGATTAATGCAGTGAACATACCGATGACAG
AAATTGCTTGAACAATTGCAGCAATAATACCATGACCACTTTCTCGTAATGCCCAACCTA
CTGGCTCTGCATTATCAGCGTATTGAGAGTAGTGGAACATGCCAACAAGAACAAGTGCTA
CGGCCACAAACAATACAATTGCTACTATGAGTGACCCTAAAATTCCTCTAGGCATTGTCT
TCTGTGGATTAATCGCTTCAGCTGAATTAGCAGCAATAGAGTCAAACCAATATAAGCTA
AGAAAATCATTGAAACTCCAGCATAAATACCTTGCCAACCTCCAAAGTCGCCAGTTTCAG
TAACCTTATGTTCTGGAATAAATGGTATATAGTTACTGAAATTAATCGCAGTTAGCCCAA
CAATCACAAATAAAATGATGGCTAACACCTTTAATATAACCAATACATTTTCCATACGAG
CGGCTTCGTTCATTCCGCGTGATAATAGTAATGCAGTTAAAATAATCACTACAGCAGCAA
```

TABLE 7-continued

```
TGATATCAATGACACCACCGTTACTTCCAAATGGATTAGATAATGATTTAGGTAAAGAAA

TGCCTAATGGTGCAATAAGACCTCTTAAGTTAGCAGAAAAGCCTGAAGCAACGAAAGCAA

CAGCAATAAAGTATTCTGCTAAAAGCGCCCAACCGGCAACCCATCCGAATAATTCACCAA

AAAGTACATTAATCCATGAATAAGCTGATCCAGCAAAAGGCATTGTAGATGCCATTTCTG

CATAAGTAAAGGCTACAAGACCTGCAACAATGGCAGCTAATAAGAATGATAATGCCACAG

CAGGTCCGGCATGCTCAGCCGCGACAACACCTGGTAAAGTGAAGATAGATGTAGAGACAA

TTGTACCAACACCTAGTGCAAGAAAGTCACGTACACGTAACGTGCGCTTAAGATGCCCAT

CTTTATTTTGATAAATAGTAGGATTCTCTTTTCGAGTCATCCGATTAAAAAAACTTCCCA

TAACAAACCTCCATAACATCAACTTACTATTAACATGAGTCAGCAAACATTCCTTAACAA

TACGTATTAAAAAATCATCTACATGTAGATAAAATGAATTGGCTGATTCTGATAATTAAT

ATAATAGCACAGAAGATGAATATTTTGTCTAAAAATTCTGAAAAATCAATAAAAATTATT

TTCCTCAGTGATTAAGTTAATATAGTAAAATTTCAATAGGCTAAAAGGATATAAATTGA

ATGTTAATATCACAGGAATTTTCATTTATGGTATTTGTCATGTATTTCTTCACATGATTT

ATAAATTAGTAAAGTAATTATATTTGGAAAACATGTTATCGTAAAAGAGAGCATCATGAT

AATGATGAAAAATAATCGGTATTAGTCAATTAAAATAATTATATACACGGAAATATTGTT

TAATGAGTGTTAGTGTATATGAATAATTGAAGAAGTTATGTTAAAAAAATGCTAGATATC

AAACGATGGTTCTATGAGAGAAGTTATCCATCAATCAAATGTTGATAATTAAGGATGAAT

ATAAATGGAAATTAAACAAATTAAATATTTCGTAGAAGTTGTACGACAAGGTGGTATGAC

GCAAGCATCTGAACACTTATACATTGCACAGTCAACGATTAGCAAAGCGATTAAAAATAT

TGAAAATGAATATGATATTACATTGTTTGACCGGTCACAAAAACAAATAAAACTAACAGA

TATAGGTCAAACATTTTATGATAATAGTTTAGAATTTTTAGCTTTATTCGAGAAATTATC

TTTAGAAATGAATGACATTGTGAACGTTCAAAAAGGTCATATTAAAATAGGCTTATCACC

AATGATGAATGTTCAAATGTTTACAAATGCATTGAATCAGTTTCACAGACTCTATCCTAA

TGTGACATATGAAGTGATTGAGGGTGGTGGTAAAATTGTTGAGAACTTAACATCTAATGA

TGATGTGGATATTGGTATTACTACATTACCTGTAGATC

LOCUS 11:
GATCCTGAAACACTATTTAT

TGTGATGAGTCAAATATTATTTCATCCGCTTGTAGGTGGATTTTTATTAGCAGCCATCCT

TGCTGCAATAATGAGTACTATCTCTTCACAATTACTAGTAACATCAAGTTCTTTAACTGA

AGATTTCTATAAACTAATCAGAGGTTCAGATAAAGCATCATCACACCAAAAAGAGTTTGT

TTTGATTGGACGCTTATCAGTTCTACTTGTTGCGATAGTTGCTATTACGATTGCTTGGCA

TCCAAACGATACAATACTAAATTTAGTTGGTAATGCTTGGGCTGGTTTTGGAGCTGCATT

TAGTCCTTTAGTACTCTACTCTTTATATTGGAAAGATTTAACACGTGCAGGAGCTATTAG

CGGAATGGTAGCTGGTGCTGTAGTTGTTATTGTTTGGATTTCTTGGATAAAACCCTTGGC

TACAATCAATGCATTCTTTGGTATGTATGAAATCATTCCAGGTTTCATAGTTAGCGTATT

GATTACGTACATCGTAAGTAAATTAACAAAAAAACCTGATGATTATGTTATTGAAAATCT

TAATAAAGTTAAACACGTCGTTAAAGAATAAATGTACAATTATCAGACTATATCAAAATT

ATAAATATTGATTAATTAAATAACAATTACAAGTATAATTTAAATATTTCTCTAATATACA

GTGTCAATTTATTTTATTCACATAAGAAAATAGCTATGAAGAAATCTATCAATTTAAATT

TCTTCATAGCTAATTTTTTTCATTTAAATTTATTGACGGCTTGAAAAATGAGTCAAAATC
```

TABLE 7-continued

```
ATCAATAACATCAAATTGCAAATATATTCCTTTGGTAATGGATTGACCATTAAACTTAAT

TCGAATTCTATTCTATTCTTTTCTATACAATGAAACGGGTGTCATACATCATCAGTAACT

AATTATGATAGATATGAACTTGTGGTTCTTTATCGTCTTTAGTTTTACTAATGAGAGCAC

GTGGAGTATTTCCATCTTTGATTCTAATTTCATACTCATCTAGTTTATCAAAATATTTTT

CGGCTTGCTCTGTAACATATTGTGTAATACCTATCGTTTCTGCCTGTCCGTAATAATCTA

TAGGCAAATCAACTGTAAGTTGTTTAGCTTTTTTATTTACGAATTTAACCTTACCAACTG

CTTGTGTGAAGTTTGAAAAATACGATTGCAAATTATCATTAAACTGTTTAAAGTTATTAT

TCAGCGTTTCATCATAATCAGCTGCAGTTGACGAAGGAATTAAGGCTGCTTTTTCATTAA

TATTATCCCAAGAGTTAATTTTAGTTTTACCCTCTTCAACCGTAGTACCAACTATAAATT

CACCTGGTGTAATGGAATCTTGACTTGATTGTTTATAGATAGCAAAATGAATAGGAATAT

CTTTCAAATCACTATTCTCACGTAAACGAGAAAGCATTTCACTAGCCATCTGTTTACCTT

GCTTTTCAATCTCTTTATCAGATAAATCTTTACTAAATGTTTCGCCATCTTTCTCTTTTT

TGTAATAATAAACACTATTCATGGCTAAACCAATTGTCATCCCTTTTATATTTTTACCTT

TAGAATCACTATTTCCATAAAAATCCTGCTCGAGTATATTTGAAAGATAGGCTGGAGAAT

TTTCAGCTATTTTCTCTTCATCTGTTTCACCATTGTGAGATGGATTGAGTCCAAGATTCT

CATTAGCATTTTGCTTTTCTTTTCTTTTTCGCTCATCTTGTCAATTTCTTTTTTCGTAT

ACTTCGGATCTAAGTATGCATTAATCGTTTTTTTATCTAAATATTGTCCATCTTGATATA

AATACTTATTTGTTGGAAAGATTTCTTTACTTAATTCTAGTAAACCACTTTCAAAATCTT

CTCCATTATAACCATTTGCCATATTATCTTGTAATAATCCACGAGCCTGGCTTTCTTTGA

AGGGTAATATAGTCCTATAGTTATCACCTTGAACTTTTTTATCAGTCGCTATTTGTTTCA

CTTGATTTTATTATGGTTATCCTTATGTTCACTTTGTTCTTTATCTGATGAAGTTTGTT

TATGTCCATCTCCGCAAGCCGTTAATAATAACAGTATCGACATGAGTAAAAATATTGTTC

GCTTCATTCACGTACTCCTCTAATTATTAGATTCCATTTTGTTTTTCAATAAATGCTGCT

TCAGTCCAAATTTCAGTACCATACTTCTCAGCTTTGGCTAATTTAGACCCTGCATCTGCT

CCAGCTATGACAATATCAGTACTTTTAGTCACGCTGTTTGTAACTTTAGCACCTTGCATT

TTCAACCATTCAGATGCTTCATTTCTCGTCATTTGCTCGAGTTTCCCTGTTAATACAATT

GTTTTCCCACTAAAATCAGGATGACCTTCGATTTCAGTTGTTTTAATTCCTTTATAAGAC

ATATTAACATTTTTATTACTTAATTTTTCAATTAATGAACGAATATCACTATTTTCGAGA

TATGTTACAACAGATTGTGCAAGTTTATCTCCAATATCTTGAATTTCAATTAATTCACTT

TCAGTTACTTTAAAAAGTTGATC

LOCUS 12:
GATCCTGACACAGCTATTTCTCTCTTAGATAATC

CTATTCAACCTTTACCTAATAATAAAGAAAGTATAATTAGATACATCAAAGGGGCAATCT

AGTATGGAGGAAGTTTTAAAACTTAAAATCCCTGCATCAACCGCGAATCTAGGTGTAGGT

TTTGACTCAATTGGTATGGCATTGGATAAATATTTGCATATGTCTATACGTAAGATTGAA

AGAGCTAATTGGGAATTTCTATATTATAGTTCAGAACTAGAAGGTTTACCTAAAGATGAG

AATAATTATATTTATCAAACTGCTCTAAATGTTGCGCGTAAATACAATGTTACACTTCCA

AGCTTGCAAATTGAAATGAGAAGTGATATTCCATTAGCTAGAGGACTAGGTTCATCTGCC

TCTGCATTAGTCGGTGCTCTTTTTATTGCTAATTACTTTGGTAATATTCAATTATCTAAA

TACGAATTGTTACAACTAGCGACTGAAATTGAGGGACACCCTGATAATGTAGCACCTACA
```

TABLE 7-continued

```
ATATATGGAGGTTTGATTGCAGGTTTTTATAATCCAATAACTAAAATAACAGATGTTGCT

AGAATAGAAGTTCCGCACGTAGATATAATTTTAACTATACCTCCATATGAGCTTCGTACA

GAAGACTCTAGAAGGGTCTTACCCGATACATTTTCACATAAAGGTGCTGTGCAAAATAGT

GCCATTAGTAACACTATGATTTGTGCTCTCATTCAGCATAAATATAAACTTGCTGGAAAG

ATGATGGAACAAGATGGTTTTCATGAACCATATAGGCAACACCTTATTCCAGAATTCAAT

CAAGTACGTAAACTATCACGTCAACATGATGCATATGCAACTGTTATCAGTGGAGCTGGA

CCTACAATACTCACTCTTTGTCCAAAAGAAAAAAGTGGTAAATTAGTTAGAACACTACGT

GAGAAAATTAATAATTGTGCTTCAGAACTAGTAACAATTAATGAAATAGGTGTTAAAGAT

GAAGTGGTGTACCTAAAGTCCTAAATTATTGTAAAATATAGTTAAGAATAAACTTTTAAT

AACTCTTGAAAGGAGTTCTATACTATATGACTCAGTATAAAATGGTAGTTTTAGATATGG

ATGATACTTTAATGAATAGTGATAATAAATTATCCATTGAGACAAAATCTTACTTATTAG

ATATTCAAAAGCGTGGTTATTATGTAGTATTGGCCTCAGGTAGACCAACAGAAGGTATGT

TACCTACTGCGAGAGAATTAGAGTTAAATAAATATAACAGCTTCATTATTAGTTATAATG

GAGGTAAAACTATAAATATGGCTAATGAAAATGTAGAGGTCGATCAGCCTGTTTCAAAGG

AAGATTTCGATAATATTGTAGATTATTGTAGAGATAAGAACTTTTTAGTACTTACTTATG

ATAATGGATATATCATTCACGATAGTAGTCATGAATATATGAACATAGAATCACAACTTA

CCGGATTACCTATGAATCGTGTTGCTGATTTGAAGGAATATATTAATCATAGTGTGCCCA

AAGTTATGGGTGTGGATTATGTAGGTCATATTACCGAAGCACGTATTGAATTGGATGGTT

ACTTCAATAATGATATTGATGTGACAACGAGTAAGCCTTTTTTCCTAGAGTTTATGGCAA

AGAATGTTTCGAAGGGGAACGCAATAAAAGCACTTTGTAAAAGATTACAAATTTCTCTAG

AAGAAGTTATAGTATTCGGGGACAGTTTGAATGATAAGTCAATGTTTGAAGTTGCTGGAT

ATTCTGTAGCAATGGGAAATGCTAGTGATGAACTCAAGAAAATTGCTGACGAGGTAACTT

TAGATAATAATTCTAACGGTATTCCTTATGCTTAAAAAGAACTTTTGGTTTAAAGTATTA

TTACAATGAATTAATATGTAAATTAATAATTTTAAGGTTAATTGAATCTGACTTCTCTAA

ATATAAGTAGTAAGTCATAAAAAACTGTCGATATAAATATAATTAAAAAATTTTCTTTTT

AATATAATATATAAGTCTGAGACATAATCTAGAATAATAGCCCGTAAATGAATTTTCAAA

ATTTATTTACGGGCTTCTTTATTCATAATATAAGTTACATAATTAACCTTCATCCATGCC

TACAATTTCTTTATTGAATATATTTAAATCTTTATTTACTTTTTCTTTCAAATCAATTGA

AAATCGAGACTTTCAATTGATTTGCTATTTCGCAGTATGTGTCCAGTCATCTTTTCCTTT

ATAGCGTTTAACATGTGCATATACTTGATC
```

TABLE 10 PROTEIN SEQUENCE STAPHYLOCOCCUS EPIDERMIDIS
LOCUS 1:
ORF1:
DQTAKLQAEKAKSEVTQSTTNVSGTQTYQDPTQVQPKQDTQSTTYDASLDEMSTYNEISS

NQKQQSLSTDDANQNQTNSVTKNQQEETNDLTQEDKTSTDTNQLQETQSVAKENEKDLGA

NANNEQQDKKMTASQPSENQAIETQTASNDNESQQKSQQVTSEQNETATPKVSNTNASGY

NFDYDDEDDDSSTDHLEPISLNNVNATSKQTTSYKYKEPAQRVTTNTVKKETASNQATID

TKQFTPFSATAQPRTVYSVSSQKTSSLPKYTPKVNSSINNYIRKKNMKAPRIEEDYTSYF

PKYGYRNGVGRPEGIVVHDTANDNSTIDGEIAFMKRNYTNAFVHAFVDGNRIIETAPTDY

LSWGAGPYGNQRFINVEIVHTHDYDSFARSMNNYADYAATQLQYYNLKPDSAENDGRGTV

WTHAAISNFLGGTDHADPHQYLRSHNYSYAELYDLIYEKYLIKTKQVAPWGTTSTKPSQP

TABLE 7-continued

```
SKPSGGTNNKLTVSANRGVAQIKPTNNGLYTTVYDSKGHKTDQVQKTLSVTKTATLGNNK

FLYVEDYNSGKKYGWVKQDGVVYNTAKAPVKVNQTYNVKAGSTLYTVPWGTPKQVASKVS

GTGNQTFKATKQQQIDKATYLYGTVNGKSGWISKYYLTTASKPSNPTKPSTNNQLTVTNN

SGVAQINAKNSGLYTTVYDTKGKTTNQIQRTLSVTKAATLGDKKFYLVGDYNTGTNYGWV

KQDEVIYNTAKSPVKINQTYNVKPGVKLHTVPWGTYNQVAGTVSGKGDR

LOCUS 2:
ORF1:
RIGGKYMDNIKIIVASDSIGETAELVARAGVSQFNPKQCKHEFLRYPYIESFENVDEVIQ

VAKDTNAIIVYTLIKPEIKKYMISKVNEHALKSVDIMGPLMELLSNSIEETPYYEPGMVH

RLDDAYFKKIDAIEFAVKYDDGKDR

ORF2:
GEAFMVKNMDTIVQLAKHRGFVFPGSDIYGGLSNTWDYGPLGVELKNNIKKAWWGKFITQ

SPYNVGIDAAILMNPKTWEASGHLGNFNDR

ORF3:
RPIELSQRQEQIIEIVKSEGPITGEHIAEKINLTRATLRPDLAILTMSGFIEARPRVGYF

YSGKSKNKIINEKLRKYVVKDYMSHPVVIKENMTVYDAICTIFLEDVSTLFITNENNDFV

GVCSRKDLLRASMIGEDIHTMPISVNMTRMPHVSYLKEQELVIYAANQMIDKEIDSLPIV

RPKENDKFEVIGRISKTTITKLVFSLFKE

LOCUS 3:
OFR1:
SVMKNFILSVQHLLAMYAGAILVPIIVGTSLKFSAEEIAYLVTVDIFMCGVATFLQANKV

TGTGLPIVLGCTFTAVAPMILIGQTKGLDVLYGSLLISGILVVLIAPFFSYLVKFFPPVV

TGSVVTIIGINLMPVAMNYLAGGEGAKNYGDTKNLILGGVTLLIILILQRFTKGFLKSIA

ILIGLAIGTALAGIFGMVDIKQVGDAHWFGFPVPFRFSGFGFDVSSILVFFIVAVVSLIE

STGVYHALSEITGRKLERKDFRKGYTEAGLAIILGSIFNAFPYTAYSQNVGLVSLSGAKK

NNVIYGMVILLLICGCIPKLGALANIIPLPVLGGAMIAMFGMVMAYGVSILGNINFQNQN

NLLIIAISVGLGAGISAVPQAFKGLGEQFAWLTQNGIVLGAISAIILNFFFNGIKYKQTE

ENVK

ORF2:
VESLGRKVKEDGVVIDEKILKVDGFLNHQIDAKLMNDVGKTFYESFKDAGITKILTIEAS

GIAPAIMASFHFDVPCLFAKKAKPSTLKDGFYSTDIHSFTKNKTSTVIVSEEFLGADDKV

LIIDDDFLANGDASLGLNDIVKQANATTVGVGIVVEKSFQNGRQRLEDAGLYVSSLCKVAS

LKGNKVTLLGEA

ORF3:
LWRLFLMWENKFAKESLTFDDVLLIPAASDVLPSDVDLSVKLSDKI

LOCUS 4:
ORF1:
YWTYHFKEKGKMVIMDDLKQNQSSNEKPKGNKIINILIFIGMILLIQIPIGVSLIALPFS

VKFSKLTSIALSMLITGTALLIIWLVRNYYLSHTYERQYQSMRGKDIFINIGFLVLSMVF

SILSSVLMVIFTGNDTTANEKEINESLDLLLQKDHLPHISIVATVVLMICIIGPYLEELL

FRGIFKETLFMKYRFWLPFIISSIIFSSQHLSTNIFSYAIYFLMGCVLYLAYNRRRNIKD

SMMVHMLNNSVSTLPVFVGYLWLYFR

ORF2:
DLHIIKGDTPEVKSHTTLGHEGIGIIEEIGDNVNNFKVGDKVIISCISSCGKCYYCKKGI

YAHCENGGGWILGHLVNGTQAEYYKVPFADNSLYHAPSNLKEDALVMLSDILPTGYEIGV
```

TABLE 7-continued

```
LKGKVKPGCTVAIVGAGPVGLAALLTAQFYSPSKIIMIDLDDNRLETAKELGATHLINSK
 ETETAIKKVKSLNPRGVDVAIEAVGIFPTFDLCQNLIGVDGTIANVGVHGLPVQLDIDKL
 WIKNINVTTGLVSGNTTEELLEALKSKIIQPEQLVTHYSKLSEIESAYDLFRNATDHKAI
 KLIIENDITI

LOCUS 5:
ORF1:
QIVQRKGCHLMKIRVIVPCYNEGEVVLKTYDKLTEIMKKDSLIKNYEYDLLFINDGSTDT
 TIHHIKNIVAYDNHVKYLSFSRNFGKEAAMIAGYQHSTMHDAVIMIDGDLQHPPEYIPQM
 IEGYIEGYDQVVAKRNRQGENFVRKTLSRCYYKLINAFVEDIQFEDGVGDFRLLSRRAVQ
 ALTTLDEYNRFSKGLFEWIGYETKVFQYENVTREDGESKWTFRKLLNYGIDGLISFNNKP
 LRMMIYLGMFTFSISILYIIYLLINILINGINIPGYFTTIAAILLLGGIQLMSIGVVGEY
 IGRIYYEVKHRPKYIVENSNIQTENLDMRYNALNLNKNRNNKRSNDLYKLSSFYKVKTYS
 DTYASNYSQDEGFKERVH

ORF2:
DQLLVNILQPYEQHIKQENRTLEVNFCTDIDAFYQYRPPIERILTNLLDNALKFSNSGSR
 IDIIISECKENDVISISIKDEGIGIVPELQSRIFERTFRVEDSRNTKTGGSGLGLYIANE
 LAQQIDASITVQSDLDIGTTMTLTLKKFQFKK

LOCUS 6:
ORF1:
SIAGAAIASQGSFAVLHYQGFTKIIIVLIISPIIAFCVGYMMYTIVKIVFKNSNLTRTNR
 NFRFEQIFTAALQSFSHGTNDAQKSMGIITLALIVGNLQDGSNVEPQVWVKVACATAMGL
 GTAVGGWKIIKTVGGNIMKIRPANGAAADISSALTIFVASSLHFPLSTTHVVSSSILGVG
 ASNRAKGVKWSTAQRMVVTWVITLPISAVLAAIIYFIIHLFLK

ORF2:
GGVTLKKLAFAITAASGAAAVLSHHDAEASTQHKVQSGESLWTIAQQYNTSVESIKQNNN
 LSNNMVFPGQVINVGGSASQNTSSNTSSSSASSHTVVAGESLNIIANKYGVSVDALMQAN
 HLNGYLIMFNQILTIPNGGSGSGSGGTATQTSGNYTSPSFNHQNLYTEGQCTWYVFDKRS
 QAGKPISTYWSDAKYWASNAANDGYQVDNTPSVGAIMQSTPGPYGHVAYVERINGDGSIL
 ISEMNYANGPYNMNYRTIPASEVSSYAFIH

LOCUS 7:
ORF1:
DHIIRAYHKFLQSGYQTELHLFGRDEDNQIPLMNTLISELKLSDKVKIFKYTNQPLQEFK
 NSKASLLTSQYEGFGLTLMESIEMGCPVLSYNVRYGPSEIIQNGINGYLIEKNDIDSKSK
 HMINIIEHPLQKVKNKDTLKYNAAVNNYKQLMQSLDLLK

ORF2:
SRGGFQVQKKYITAIIGTTALSALASTHAQAATTHTVKSGESVWSISHKYGISIAKLKSL
 NGLTSNLIFPNQVLKVSGSSSRATSTNSGTVYTVKAGDSLSSIAAKYGTTYQKIMQLNGL
 NNYLIFPGQKLKVSGKATSSSRAKASGSSGRTATYTVKYGDSLSAIASKYGTTYQKIMQL
 NGLTNFFIYPGQKLKVPGGSSSSSSSNNTRSNGGYYSPTFNHQNLYTWGQCTWHVFNRRA
 EIGKGISTYWWNANNWDNASAADGYTIDYRPTVGSIAQTDAGYYGHVAFVERVNSDGSIL
 VSEMNWSAAPGNMTYTRIPAYQVRNYKFIH

LOCUS 8:
ORF1:
DQFREAMTKFPVWMGATTLFFGAINGAKEMLDVITEIDGKMITLAKVTGDDNALQQTFID
 ANNAASQFGQTLGSVLDVYAEFARQGVKGNELSQFSNAALIAANVGEIDAKQASEYLTSM
```

TABLE 7-continued

```
SAQWETTGNQAMRQVDSLNEVSNKYATTVEKLAQGQAKAGSTAKSMGLTFDETNGIIGAL

TAKTKQSGDEIGNFMKATLPKLYSGKGKSTIEGLGISMKDENGQLKSAISLLEEVSQKTK

NLEKDQKAAVINGLGGTYHYQRMQVLLDDLSKTDGLYKQIKESSESSAGSALQENAKYME

SIEAKVNQAKTAFEQFALAVGETFAKSGMLDGIRMVTQLLTGLTHGITELGTTAPIFGMV

GGAASLMSKNVRSGFEGARSSVANYITEVNKLAKVNNAAGQVVGLQKVQTGTASQLQFNK

NGEYDKAASQAKAAEQATYQFSKAQKDVSASAMIASGAINKTTVATTASTVATRAATLAV

NGLKLAFRGLLAATGVGLAITGVSFVLEKVVGSFNAASQAAEQYKQKQEQTKQAIASMSN

GEINSLISSYDKLQQKMNSGSAFNTAEAEKYKEVTSQLANIFPDLVTGENRYGKEMAGNK

EVMKQKIELIKQEMELERQKNAIKQKEEQDAYIKEQDSLAKKNRGQKWYQLGQTPELKLQ

EQARPTTVSDNSNINKINATIQKVKSQAQAEKALEQVDKQLAQSQTKNRQNEVQHLQKVR

QALQDYITKTGQANQATRAAVLTAQQQFTNQIATMKKLGTTGQQVMTTISNSVAKTAKSG

KAAQATFKSFETSLVKSSSFKSKMASYEASVKKFKNAANQSAKIAALKDVERDYSKVAKG

IMQAAKAANMSKSQMKDLKKSLQQNIQAETGFRASVSKAGKVTIDQSKKIKQNR
```

LOCUS 9:
ORF1:
```
VLWGVFDMDLLIGTLFLILVLVIFTLFTYKAPSGMRAMGALANAAIASFLVEAFNKYVGG

QVFGIKFLEELGDAAGGLGGVAAAGLTALAIGVSPVYALVIGAACGGMDLLPGFFAGYIV

GYMMKYTEKYVPDGIDLIGSIILLAPIARLIATGLTPVVNNTLIKIGDIIQSSTDANPLI

MGIVLGGIITVVGTAPLSSMALTALLGLTGAPMAIGAMAAFSSAFMNSALFHRLKLGDRK

STISVGIEPLSQADIVSANPIPIYVTNFFGGAIAGIIIAWSGMINNATGTATPIAGFLVM

FGFNSLTKVIIIYGVMAIIGTIAGIVGSIVFKKYPIITKKQMLERDTTT
```

LOCUS 10:
ORF1:
```
MEIKQIKYFVEVVRQGGMTQASEHLYIAQSTISKAIKNIENEYDITLFDRSQKQIKLTDI

GQTFYDNSLEFLALFEKLSLEMNDIVNVQKGHIKIGLSPMMNVQMFTNALNQFHRLYPNV

TYEVIEGGGKIVENLTSNDDVDIGITTLPVDL
```

ORF2:
```
LSESANSFYLHVDDFLIRIVKECLLTHVNSKLMLWRFVMGSFFNRMTRKENPTIYQNKDG

HLKRTLRVRDFLALGVGTIVSTSIFTLPGVVAAEHAGPAVALSFLLAAIVAGLVAFTYAE

MASTMPFAGSAYSWINVLFGELFGWVAGWALLAEYFIAVAFVASGFSANLRGLIAPLGIS

LPKSLSNPFGSNGGVIDIIAAVVIILTALLLSRGMNEAARMENVLVILKVLAIILFVIVG

LTAINFSNYIPFIPEHKVTETGDFGGWLGIYAGVSMIFLAYIFGDSIAANSAEAINPQKT

MPRGILGSLIVAIVLFVAVALVLVGMFHYSQYADNAEPVGWALRESGHGIIAAIVQAISV

IGMFTALIGMMLAGSRLLYSFGRDGLLPSWLSQLNHKHLPNRALVILTIIGVVIGSR
```

LOCUS 11:
ORF1:
```
DPETLFIVMSQILFHPLVGGFLLAAILAAIMSTISSQLLVTSSSLTEDFYKLIRGSDKAS

SHQKEFVLIGRLSVLLVAIVAITIAWHPNDTILNLVGNAWAGFGAAFSPLVLYSLYWKDL

TRAGAISGMVAGAVVVIVWISWIKPLATINAFFGMYEIIPGFIVSVLITYIVSKLTKKPD

DYVIENLNKVHVVKE
```

ORF2:
```
DQLFKVTESELIEIQDIGDKLAQSVVTYLENSDIRSLIEKLSNKNVNMSYKGIKTTEIEG

HPDFSGKTIVLTGKLEQMTRNEASEWLKMQGAKVTNSVTKSTDIVIAGADAGSKLAKAEK

YGTEIWTEAAFIEKQNGI
```

TABLE 7-continued

ORF3:
MKRTIFLLMSILLLLTACGDGHKQTSSDKEQSEHKDNHNKNQVKQIATDKKVQGDNYRTI

LPFKESQARGLLQDNMANGYNGEDFESGLLELSKEIFPTNKYLYQDGQYLDKKTINAYLD

PKYTKKEIDKMSEKEKKSKNANENLGLNPSHNGETDEEKIAENSPAYLSNILEQDFYGNS

DSKGKNIKGMTIGLAMNSVYYYKKEKDGETFSKDLSDKEIEKQGKQMASEMLSRLRENSD

LKDIPIHFAIYKQSSQDSITPGEFIVGTTVEEGKTKINSWDNINEKAALIPSSTAADYDE

TLNNNFKQFNDNLQSYFSNFTQAVGKVKFVNKKAKQLTVDLPIDYYGQAETIGITQVVTE

QAEKYFDKLDEYEIRIKDGNTPRALISKTKDDKEPQVHIYHN

LOCUS 12:
ORF1:
LDTSKGQSSMEEVLKLKIPASTANLGVGFDSIGMALKDYLHMSIRKIERANWEFLYYSSE

LEGLPKDENNYIYQTALNVARKYNVTLPSLQIEMRSDIPLARGLGSSASALVGALFIANY

FGNIQLSKYELLQLATEIEGHPDNVAPTIYGGLIAGFYNPITKITDVARIEVPHVDIILT

IPPYELRTEDSRRVLPDTFSHKGAVQNSAISNTMICALIQHKYKLAGKMMEQDGFHEPYR

QHLIPEFNQVRKLSRQHDAYATVISGAGPTILTLCPKEKSGKLVRTLREKINNCASELVT

INEIGVKDEVVYLKS

ORF2:
LLKGVLYYMTQYKMVVLDMDDTLMNSDNKLSIETKSYLLDIQKRGYYVVLASGRPTEGML

PTARELELNKYNSFIISYNGGKTINMANENVEVDQPVSKEDFDNIVDYCRDKNFLVLTYD

NGYIIHDSSHEYMNIESQLTGLPMNRVADLKEYINHSVPKVMGVDYVGHITEARIELDGY

FNNDIDVTTSKPFFLEFMAKNVSKGNAIKALCKRLQISLEEVIVFGDSLNDKSMFEVAGY

SVAMGNASDELKKIADEVTLDNNSNGIPYALKELLV

| SEQ ID NO | Sequence Name | SEQ ID NO | Sequence Name |
|---|---|---|---|
| | TABLE 7 | SEQ ID NO: 30 | LOCUS 27B (A5) |
| | | SEQ ID NO: 31 | LOCUS 27C (A7) |
| SEQ ID NO: 1 | LOCUS 1 (E8/B1/116) | SEQ ID NO: 32 | LOCUS 27D (AF7) |
| SEQ ID NO: 2 | LOCUS 2 (B10/I15) | SEQ ID NO: 33 | LOCUS 28 (H130) |
| SEQ ID NO: 3 | LOCUS 3 | SEQ ID NO: 34 | LOCUS 29 (A)N10 |
| SEQ ID NO: 4 | LOCUS 4 (E103) | SEQ ID NO: 35 | LOCUS 29 (B)GE2 |
| SEQ ID NO: 5 | LOCUS 5 (L4) | SEQ ID NO: 36 | LOCUS 30 (N15) |
| SEQ ID NO: 6 | LOCUS 6 (D1) | SEQ ID NO: 37 | LOCUS 31 |
| SEQ ID NO: 7 | LOCUS 7 (D3) | SEQ ID NO: 38 | LOCUS 32A (HE9) |
| SEQ ID NO: 8 | LOCUS 8 (D4) | SEQ ID NO: 39 | LOCUS 32B (P9) |
| SEQ ID NO: 9 | LOCUS 9A (D22) | SEQ ID NO: 40 | LOCUS 33 (O14) |
| SEQ ID NO: 10 | LOCUS 9B (I2) | SEQ ID NO: 41 | LOCUS 34 (O18) |
| SEQ ID NO: 11 | LOCUS 9C (J13) | SEQ ID NO: 42 | LOCUS 35A (P13) |
| SEQ ID NO: 12 | LOCUS 9D (M11) | SEQ ID NO: 43 | LOCUS 35B (P15) |
| SEQ ID NO: 13 | LOCUS 9E (M13) | SEQ ID NO: 44 | LOCUS 36 (P5) |
| SEQ ID NO: 14 | LOCUS 10 (D9) | SEQ ID NO: 45 | LOCUS 37 (P8) |
| SEQ ID NO: 15 | LOCUS 11 (D10) | SEQ ID NO: 46 | LOCUS 38 (P16) |
| SEQ ID NO: 16 | LOCUS 12 ( ) | SEQ ID NO: 47 | LOCUS 39 (HB3) |
| SEQ ID NO: 17 | LOCUS 13 (D18) | SEQ ID NO: 48 | LOCUS 40 (HB5) |
| SEQ ID NO: 18 | LOCUS 14 (D21) | SEQ ID NO: 49 | LOCUS 41 (HB7) |
| SEQ ID NO: 19 | LOCUS 15 (I1) | SEQ ID NO: 50 | LOCUS 42 (HB8) |
| SEQ ID NO: 20 | LOCUS 17 (I3) | SEQ ID NO: 51 | LOCUS 43 (HB10) |
| SEQ ID NO: 21 | LOCUS 18 (I5) | SEQ ID NO: 52 | LOCUS 44 (HD7) |
| SEQ ID NO: 22 | LOCUS 19 (I8) | SEQ ID NO: 53 | LOCUS 45 (HD9) |
| SEQ ID NO: 23 | LOCUS 20 (J7/M10) | SEQ ID NO: 54 | LOCUS 46 (HE9) |
| SEQ ID NO: 24 | LOCUS 21 (G3) | SEQ ID NO: 55 | LOCUS 47 HF6 |
| SEQ ID NO: 25 | LOCUS 22 (I19) | SEQ ID NO: 56 | LOCUS 49 (A) B13 |
| SEQ ID NO: 26 | LOCUS 24 (L10) | SEQ ID NO: 57 | LOCUS 49 (B) K16 |
| SEQ ID NO: 27 | LOCUS 25 (HA4) | SEQ ID NO: 58 | LOCUS 50 (A) GB2 |
| SEQ ID NO: 28 | LOCUS 26 (L19) | SEQ ID NO: 59 | LOCUS 50 (B) G10 |
| SEQ ID NO: 29 | LOCUS 27A (A2) | SEQ ID NO: 60 | LOCUS 51 (GC8) |

-continued

| SEQ ID NO | Sequence Name |
|---|---|
| SEQ ID NO: 61 | LOCUS 52 (E1) |
| SEQ ID NO: 62 | LOCUS 53 (E20) |
| SEQ ID NO: 63 | LOCUS 54 (E1055) |
| SEQ ID NO: 64 | LOCUS 55 (E18) |
| SEQ ID NO: 65 | LOCUS 56 (F5) |
| SEQ ID NO: 66 | LOCUS 57 (F3) |
| SEQ ID NO: 67 | LOCUS 58 (G8) |
| SEQ ID NO: 68 | LOCUS 59 (G23) |
| SEQ ID NO: 69 | LOCUS 60 (G29) |
| SEQ ID NO: 70 | LOCUS 61A (HA7) |
| SEQ ID NO: 71 | LOCUS 61B (G28) |
| SEQ ID NO: 72 | LOCUS 62 (H3) |
| SEQ ID NO: 73 | LOCUS 63 (GD10) |
| SEQ ID NO: 74 | LOCUS 64 (F5) |
| SEQ ID NO: 75 | LOCUS 65 (F110) |
| SEQ ID NO: 76 | LOCUS 66 (E1) |
| SEQ ID NO: 77 | LOCUS 67 (F119) |
| SEQ ID NO: 78 | LOCUS 68 (G27) |
| SEQ ID NO: 79 | LOCUS 69 (H110) |
| SEQ ID NO: 80 | LOCUS 70 E100 |
| SEQ ID NO: 81 | LOCUS 71 |
| SEQ ID NO: 82 | LOCUS 72 |
| SEQ ID NO: 83 | LOCUS 73 |
| SEQ ID NO: 84 | LOCUS 74 |
| SEQ ID NO: 85 | LOCUS 75 |
| SEQ ID NO: 86 | LOCUS 76 |
| SEQ ID NO: 87 | LOCUS 77 |
| SEQ ID NO: 88 | LOCUS 78 |
| SEQ ID NO: 89 | LOCUS 79 |
| SEQ ID NO: 90 | LOCUS 80 |
| SEQ ID NO: 91 | LOCUS 81 |
| SEQ ID NO: 92 | LOCUS 83 |

-continued

| SEQ ID NO | Sequence Name |
|---|---|
| SEQ ID NO: 93 | LOCUS 84 |
| SEQ ID NO: 94 | LOCUS 85 (F126) |
| SEQ ID NO: 95 | LOCUS 86 |
| SEQ ID NO: 96 | LOCUS 87 |
| SEQ ID NO: 97 | LOCUS 88 |
| SEQ ID NO: 98 | LOCUS 89 |
| SEQ ID NO: 99 | LOCUS 92 F102 |
| SEQ ID NO: 100 | LOCUS 93 H128 |
| SEQ ID NO: 101 | LOCUS 94 HA2 |
| SEQ ID NO: 102 | LOCUS 95 HA5 |
| SEQ ID NO: 103 | LOCUS 96 |
| SEQ ID NO: 104 | LOCUS 97 (HA12) |
| SEQ ID NO: 105 | LOCUS 98 GE2 |
| SEQ ID NO: 106 | LOCUS 99 GE3 |
| SEQ ID NO: 107 | LOCUS 100 GF5 |
| SEQ ID NO: 108 | LOCUS 101 (GF7) |
| SEQ ID NO: 109 | LOCUS 102 (GF9) |
| SEQ ID NO: 110 | LOCUS 103 (GF11) |
| SEQ ID NO: 111 | LOCUS 104 (GF12) |
| SEQ ID NO: 112 | LOCUS 105 (E18) |
| SEQ ID NO: 113 | LOCUS 106 (E101) |
| SEQ ID NO: 114 | LOCUS 107 (E110) |
| SEQ ID NO: 115 | LOCUS 108 (E125) |
| SEQ ID NO: 116 | LOCUS 109 (F101) |
| SEQ ID NO: 117 | LOCUS 110 |
| SEQ ID NO: 118 | LOCUS 111 |
| SEQ ID NO: 119 | Table 7, Sequence 119 |
| SEQ ID NO: 120 | LOCUS 113 |
| SEQ ID NO: 121 | LOCUS 114 |
| SEQ ID NO: 122 | LOCUS 115 |

TABLE 8

| | |
|---|---|
| SEQ ID NO: 123 | LOCUS 1 (E8/B1/I16) >G1832__STAAU8325, UNDEFINED PRODUCT 1724158:1725096 REVERSE MW: 34671 |
| SEQ ID NO: 124 | >G1834__STAAU8325, UNDEFINED PRODUCT 1725193:1725327 REVERSE MW: 5264 |
| SEQ ID NO: 125 | >G1835__STAAU8325, UNDEFINED PRODUCT 1725449:1726531 REVERSE MW: 40775 |
| SEQ ID NO: 126 | >G1837__STAAU8325, UNDEFINED PRODUCT 1726810:1727562 REVERSE MW: 28926 |
| SEQ ID NO: 127 | LOCUS 2 (B10/I15) >G0678__STAAU8325, UNDEFINED PRODUCT 661503:665291 FORWARD MW: 138168 |
| SEQ ID NO: 128 | LOCUS 3 >G1419__STAAU8325, UNDEFINED PRODUCT 1379120:1380817 FORWARD MW: 61188 |
| SEQ ID NO: 129 | >G1420__STAAU8325, UDEFINED PRODUCT 1381154:1383838 FORWARD MW: 100947 |
| SEQ ID NO: 130 | >G1421__STAAU8325, UNDEFINED PRODUCT 1383972:1384061 FORWARD MW: 3459 |
| SEQ ID NO: 131 | LOCUS 4 (E103) >G2652__STAAU8325, UNDEFINED PRODUCT 2537955:2540798 REVERSE MW: 104512 |
| SEQ ID NO: 132 | LOCUS 5 (L4) >G0788__STAAU8325, UNDEFINED PRODUCT 779770:781077 FORWARD MW: 50070 |
| SEQ ID NO: 133 | >00790__STAAU8325, UNDEFINED PRODUCT 781580:782542 FORWARD MW: 36381 |
| SEQ ID NO: 134 | >00791__STAAU8325, UNDEFINED PRODUCT 783104:784057 FORWARD MW: 35954 |
| SEQ ID NO: 135 | LOCUS 6 (D1) >G0659__STAAU8325, UNDEFINED PRODUCT 644649:646835 REVERSE MW: 79536 |
| SEQ ID NO: 136 | LOCUS 7 (D1) >G2308__STAAU8325, UNDEFINED PRODUCT 2206377:2207831 REVERSE MW: 54671 |
| SEQ ID NO: 137 | 22 G2309__STAAU8325, UNDEFINED PRODUCT 2207850:2208050 REVERSE MW: 7893 |
| SEQ ID NO: 138 | >G2310__STAAU8325, UNDEFINED PRODUCT 2208050:2208157 REVERSE MW: 4396 |
| SEQ ID NO: 139 | LOCUS 8 (D4) >G1191__STAAU8325, UNDEFINED PRODUCT 1158690:1159313 FORWARD MW: 24008 |
| SEQ ID NO: 140 | >G1192__STAAU8325, UNDEFINED PRODUCT 1159361:1161214 FORWARD MW: 67451 |

TABLE 8-continued

| | |
|---|---|
| SEQ ID NO: 141 | LOCUS 9A (D22) AA SEQUENCE >G0560_STAAU8325, UNDEFINED PRODUCT 529664:558268 FORWARD MW: 1029886 |
| SEQ ID NO: 142 | LOCUS 9B (I2) AA SEQUENCE >G0558 STAAU8325, UNDEFINED PRODUCT 527809:529263 FORWARD MW: 51904 |
| SEQ ID NO: 143 | >G0560_STAAU8325, UNDEFINED PRODUCT 529664:558268 FORWARD MW: 1029886 |
| SEQ ID NO: 144 | LOCUS 9C (J13) AA SEQUENCE |
| SEQ ID NO: 145 | LOCUS 9D (M11) AA SEQUENCE >G0560_STAAU8325, UNDEFINED PRODUCT 529664:558268 FORWARD MW: 1029886 |
| SEQ ID NO: 146 | LOCUS 9E (M13) AA SEQUENCE >G0560_STAAU8325, UNDEFINED PRODUCT 529664:558268 FORWARD MW: 1029886 |
| SEQ ID NO: 147 | LOCUS 10 (D9) >G2169_STAAU8325, UNDEFINED PRODUCT 2045731:2047263 FORWARD MW: 55179 |
| SEQ ID NO: 148 | >G2167_STAAU8325, UNDEFINED PRODUCT 2044443:2045375 REVERSE MW: 33794 |
| SEQ ID NO: 149 | LOCUS 11 (D10) >G2285_STAAU8325, UNDEFINED PRODUCT 2183380:2183499 REVERSE NW: 4917 |
| SEQ ID NO: 150 | >G2286_STAAU8325, UNDEFINED PRODUCT 2183646:2184428 REVERSE NW: 27575 |
| SEQ ID NO: 151 | >G2287_STAAU8325, UNDEFINED PRODUCT 2184634:2185257 REVERSE NW: 22980 |
| SEQ ID NO: 152 | LOCUS 12 ( ) >G1787_STAAU8325, UNDEFINED PRODUCT 1678934:1683439 REVERSE NW: 166665 |
| SEQ ID NO: 153 | LOCUS 13 (D18) >G1977_STAAU8325, UNDEFINED PRODUCT 1846179:1847864 REVERSE MW: 62494 |
| SEQ ID NO: 154 | LOCUS 14 (D21) >G2377_STAAU8325, UNDEFINED PRODUCT 2262585:2263772 REVERSE MW: 42602 |
| SEQ ID NO: 155 | >G2375_STAAU8325, UNDEFINED PRODUCT 2261702:2262559 REVERSE MW: 30982 |
| SEQ ID NO: 156 | >G2374_STAAU8325, UNDEFINED PRODUCT 2260182:2261696 REVERSE MW: 56424 |
| SEQ ID NO: 157 | LOCUS 15 (I1) >G2097_STAAU8325, UNDEFINED PRODUCT 1973418:1974263 REVERSE MW: 31442 |
| SEQ ID NO: 158 | >G2096_STAAU8325, UNDEFINED PRODUCT 1972580:1973401 REVERSE MW: 30395 |
| SEQ ID NO: 159 | LOCUS 17 (I3) >G1894_STAAU8325, UNDEFINED PRODUCT 1776805:1778031 REVERSE MW: 45559 |
| SEQ ID NO: 160 | >G1893_STAAU8325, UNDEFINED PRODUCT 1775112:1776845 REVERSE MW: 64202 |
| SEQ ID NO: 161 | LOCUS 18 (I5) >G2386_STAAU8325, UNDEFINED PRODUCT 2274220:2275152 REVERSE MW: 33616 |
| SEQ ID NO: 162 | >G2387_STAAU8325, UNDEFINED PRODUCT 2275222:2276658 REVERSE MW: 57062 |
| SEQ ID NO: 163 | LOCUS 19 (I8) >G2296_STAAU8325, UNDEFINED PRODUCT 2195143:2196150 REVERSE MW: 37749 |
| SEQ ID NO: 164 | G2295_STAAU8325, UNDEFINED PRODUCT 2193368:2195119 REVERSE MW: 66415 |
| SEQ ID NO: 165 | >G2294_STAAU8325, UNDEFINED PRODUCT 2192119:2193372 REVERSE MW: 44835 |
| SEQ ID NO: 166 | LOCUS 20 (J7/M10) >G2187_STAAU8325, UNDEFINED PRODUCT 2068723:2070984 REVERSE MW: 85428 |
| SEQ ID NO: 167 | >G2186_STAAU8325, UNDEFINED PRODUCT 2067945:2068697 REVERSE MW: 28498 |
| SEQ ID NO: 168 | >G2185_STAAU8325, UNDEFINED PRODUCT 2065846:2067657 REVERSE MW: 69718 |
| SEQ ID NO: 169 | >G2184_STAAU8325, UNDEFINED PRODUCT 2065335:2065676 FORWARD MW: 12828 |
| SEQ ID NO: 170 | >G2183_STAAUB325, UNDEFINED PRODUCT 2063238:2065145 REVERSE MW: 71718 |
| SEQ ID NO: 171 | >G2182_STAAU8325, UNDEFINED PRODUCT 2062946:2063050 FORWARD MW: 3842 |
| SEQ ID NO: 172 | >G2181_STAAU8325, UNDEFINED PRODUCT 2061438:2062628 FORWARD MW: 42182 |
| SEQ ID NO: 173 | >G2180_STAAU8325, UNDEFINED PRODUCT 2059156:2061414 FORWARD MW: 84609 |
| SEQ ID NO: 174 | >G2179_STAAU8325, UNDEFINED PRODUCT 2057714:2058967 FORWARD MW: 46482 |
| SEQ ID NO: 175 | LOCUS 21 (G3) G1927FRG |

TABLE 8-continued

| | |
|---|---|
| SEQ ID NO: 176 | >G1928__STAAU8325, UNDEFINED PRODUCT 1810990:1811910 REVERSE MW: 32866 |
| SEQ ID NO: 177 | G1929 |
| SEQ ID NO: 178 | LOCUS 22 (I19) >G0974 FRG__STAAU8325, UNDEFINED PRODUCT 974673:975977 REVERSE MW: 47346 |
| SEQ ID NO: 179 | >G0975__STAAU8325, UNDEFINED PRODUCT 975981:977042 REVERSE MW: 40300 |
| SEQ ID NO: 180 | >G0976 FRG__STAAU8325, UNDEFINED PRODUCT 977071:978240 REVERSE MW: 43249 |
| SEQ ID NO: 181 | LOCUS 24: G0243FRG |
| SEQ ID NO: 182 | >G0244__STAAU8325, UNDEFINED PRODUCT 218549:220261 FORWARD MW: 61780 |
| SEQ ID NO: 183 | >LOCUS 25: G0027__STAAU8325, UNDEFINED PRODUCT 32103:32513 REVERSE MW: 16524 |
| SEQ ID NO: 184 | LOCUS 26: >G2458FRG__STAAU8325, UNDEFINED PRODUCT 2348221:2350185 REVERSE MW: 69055 |
| SEQ ID NO: 185 | >G2459__STAAU8325, UNDEFINED PRODUCT 2350185:2351102 REVERSE MW: 32573 |
| SEQ ID NO: 186 | G2460FRG |
| SEQ ID NO: 187 | LOCUS 27: G1326FRG |
| SEQ ID NO: 188 | >G1327__STAAU8325, UNDEFINED PRODUCT 1284689:1285450 FORWARD MW: 27870 |
| SEQ ID NO: 189 | >G1329__STAAU8325, UNDEFINED PRODUCT 1285505:1286227 FORWARD MW: 26340 |
| SEQ ID NO: 190 | >G1330__STAAU8325, UNDEFINED PRODUCT 1286327:1287067 FORWARD MW: 26652 |
| SEQ ID NO: 191 | >G1332__STAAU8325, UNDEFINED PRODUCT 1287228:1287941 FORWARD MW: 25679 |
| SEQ ID NO: 192 | >G1333__STAAU8325, UNDEFINED PRODUCT 1288095:1288811 FORWARD MW: 25655 |
| SEQ ID NO: 193 | >G1334FRAG.__STAAU8325, UNDEFINED PRODUCT 1288994:1290730 FORWARD MW: 66904 |
| SEQ ID NO: 194 | ORF1 (AF7) |
| SEQ ID NO: 195 | ORF2 (AF7) |
| SEQ ID NO: 196 | LOCUS 28 (H130) >G1388__STAAU8325, UNDEFINED PRODUCT 1337496:1338446 REVERSE MW: 36053 |
| SEQ ID NO: 197 | >G1389__STAAU8325, UNDEFINED PRODUCT 1338556:1339734 FORWARD MW: 43345 |
| SEQ ID NO: 198 | >G1390__STAAU8325, UNDEFINED PRODUCT 1340025:1342439 FORWARD MW: 91754 |
| SEQ ID NO: 199 | LOCUS 29A (N10/GE2) >G2804__STAAU8325, UNDEFINED PRODUCT 2682166:2682924 REVERSE MW: 29096 |
| SEQ ID NO: 200 | >G2805__STAAU8325, UNDEFINED PRODUCT 2683043:2685673 REVERSE MW: 93576 |
| SEQ ID NO: 201 | >G2806__STAAU8325, UNDEFINED PRODUCT 2686026:2686727 REVERSE MW: 27428 |
| SEQ ID NO: 202 | LOCUS 30 (N15) G2078__STAAU8325, UNDEFINED PRODUCT 1955555:1957645 REVERSE MW: 77813 |
| SEQ ID NO: 203 | >G2077__STAAU8325, UNDEFINED PRODUCT 1954445:1955323 REVERSE MW: 31822 |
| SEQ ID NO: 204 | LOCUS 31 >G2117__STAAU8325, UNDEFINED PRODUCT 1991063:1995499 REVERSE MW: 170933 |
| SEQ ID NO: 205 | LOCUS 32 HE9 >G2647__STAAU8325, UNDEFINED PRODUCT 2528508:2529707 REVERSE MW: 44138 |
| SEQ ID NO: 206 | LOCUS 32 P9 >G2648__STAAU8325, UNDEFINED PRODUCT 2530085:2534971 REVERSE MW: 178787 |
| SEQ ID NO: 207 | LOCUS 33 >G2811__STAAU8325, UNDEFINED PRODUCT 2691933:2692430 REVERSE MW: 19378 |
| SEQ ID NO: 208 | >G2812__STAAU8325, UNDEFINED PRODUCT 2692749:2694275 REVERSE MW: 56329 |
| SEQ ID NO: 209 | LOCUS 34 >G1540__STAAU8325, UNDEFINED PRODUCT 1494147:1495196 FORWARD MW: 38745 |
| SEQ ID NO: 210 | >G1539__STAAU8325, UNDEFINED PRODUCT 1493258:1493938 REVERSE MW: 24836 |

TABLE 8-continued

| | |
|---|---|
| SEQ ID NO: 211 | LOCUS 35 P15 >G2062__STAAU8325, UNDEFINED PRODUCT 1927377:1928480 FORWARD MW: 40937 |
| SEQ ID NO: 212 | >02063__STAAU8325, UNDEFINED PRODUCT 1928805:1936238 REVERSE MW: 263021 |
| SEQ ID NO: 213 | LOCUS 36 >G2732__STAAU8325, UNDEFINED PRODUCT 2619995:2620498 REVERSE MW: 19899 |
| SEQ ID NO: 214 | >G2733__STAAU8325, UNDEFINED PRODUCT 2620759:2621457 REVERSE MW: 24203 |
| SEQ ID NO: 215 | >G2734__STAAU8325, UNDEFINED PRODUCT 2622068:2623216 REVERSE MW: 40979 |
| SEQ ID NO: 216 | LOCUS 37 >G2805__STAAU8325, UNDEFINED PRODUCT 2683043:2685673 REVERSE MW: 93576 |
| SEQ ID NO: 217 | >G2806__STAAU8325, UNDEFINED PRODUCT 2686026:2686727 REVERSE MW: 27428 |
| SEQ ID NO: 218 | LOCUS 38 >G0307__STAAU8325, UNDEFINED PRODUCT 273255:274481 REVERSE MW: 45016 |
| SEQ ID NO: 219 | LOCUS 39 >G0761__STAAU8325, UNDEFINED PRODUCT 754164:754763 REVERSE MW: 23413 |
| SEQ ID NO: 220 | >G0762__STAAU8325, UNDEFINED PRODUCT 754732:756288 REVERSE MW: 59413 |
| SEQ ID NO: 221 | >G0763__STAAU8325, UNDEFINED PRODUCT 756281:759967 REVERSE MW: 139830 |
| SEQ ID NO: 222 | LOCUS 40 >G2781__STAAU8325, UNDEFINED PRODUCT 2662464:2663147 REVERSE MW: 26238 |
| SEQ ID NO: 223 | >G2782__STAAU8325, UNDEFINED PRODUCT 2663414:2665033 REVERSE MW: 60237 |
| SEQ ID NO: 224 | >G2787__STAAU8325, UNDEFINED PRODUCT 2666088:2667935 REVERSE MW: 70480 |
| SEQ ID NO: 225 | LOCUS 41 >G2567__STAAU8325, UNDEFINED PRODUCT 2448105:2448794 REVERSE MW: 25305 |
| SEQ ID NO: 226 | >G2568__STAAU8325, UNDEFINED PRODUCT 2448892:2449062 REVERSE MW: 6765 |
| SEQ ID NO: 227 | >G2569__STAAU8325, UNDEFINED PRODUCT 2449038:2450111 REVERSE MW: 40086 |
| SEQ ID NO: 228 | >G2570__STAAU8325, UNDEFINED PRODUCT 2450449:2451411 REVERSE MW: 36053 |
| SEQ ID NO: 229 | LOCUS 42 G2383 >G2383__STAAU8325, UNDEFINED PRODUCT 2270269:2271210 REVERSE MW: 35868 |
| SEQ ID NO: 230 | G2384 >G2383__STAAU8325, UNDEFINED PRODUCT 2270269:2271210 REVERSE MW: 35868 |
| SEQ ID NO: 231 | G2385 >G2385__STAAU8325, UNDEFINED PRODUCT 2272315:2273223 REVERSE MW: 34812 |
| SEQ ID NO: 232 | G1925 >G1925__STAAU8325, UNDEFINED PRODUCT 1807198:1808076 FORWARD MW: 33043 |
| SEQ ID NO: 233 | G1926 >G1926__STAAU8325, UNDEFINED PRODUCT 1808110:1809648 FORWARD MW: 56155 |
| SEQ ID NO: 234 | G1927 >G1927__STAAU8325, UNDEFINED PRODUCT 1809759:1810976 REVERSE MW: 44221 |
| SEQ ID NO: 235 | LOCUS 44 >G2207__STAAU8325, UNDEFINED PRODUCT 2094883:2096472 FORWARD MW: 59177 |
| SEQ ID NO: 236 | LOCUS 45 >G2152__STAAU8325, UNDEFINED PRODUCT 2029896:2030945 REVERSE MW: 39494 |
| SEQ ID NO: 237 | LOCUS 46 G5 (1) >G2647__STAAU8325, UNDEFINED PRODUCT 2528508:2529707 REVERSE MW: 44138 |
| SEQ ID NO: 238 | >G2648__STAAU8325, UNDEFINED PRODUCT 2530085:2534971 REVERSE NW: 178787 |
| SEQ ID NO: 239 | LOCUS 47 HF6 >G2560__STAAU8325, UNDEFINED PRODUCT 2436743:2440789 REVERSE MW: 146086 |
| SEQ ID NO: 240 | >G2561__STAAU8325, UNDEFINED PRODUCT 2441159:2444143 REVERSE MW: 107795 |
| SEQ ID NO: 241 | LOCUS 49 B13 G1539 >G1539__STAAU8325, UNDEFINED PRODUCT 1493258:1493938 REVERSE MW: 24836 |
| SEQ ID NO: 242 | G1540 >G1540__STAAU8325, UNDEFINED PRODUCT 1494147:1495196 FORWARD MW: 38745 |
| SEQ ID NO: 243 | LOCUS 49 K16 G1540 >G1540__STAAU8325, UNDEFINED PRODUCT 1494147:1495196 FORWARD MW: 38745 |
| SEQ ID NO: 244 | G1542 >G1542 -PL STAAU8325, UNDEFINED PRODUCT 1495403:1497337 FORWARD MW: 72192 |
| SEQ ID NO: 245 | G1543 >G1543__STAAU8325, UNDEFINED PRODUCT 1497540:1497668 REVERSE MW: 4973 |

TABLE 8-continued

| | |
|---|---|
| SEQ ID NO: 246 | G1544 >G1544__STAAU8325, UNDEFINED PRODUCT 1497751:1497846 REVERSE MW: 3849 |
| SEQ ID NO: 247 | G1456 >NONE, UNDEFINED PRODUCT 1497815:1498165 REVERSE MW: 12767 |
| SEQ ID NO: 248 | LOCUS 50 GB2 >G1392__STAAU8325, UNDEFINED PRODUCT 1343118:1349675 FORWARD MW: 238192 |
| SEQ ID NO: 249 | LOCUS 50 G10 >G1392__STAAU8325, UNDEFINED PRODUCT 1343118:1349675 FORWARD MW: 238192 |
| SEQ ID NO: 250 | LOCUS 51 (GC8) >G2831 FRG__STAAU8325, UNDEFINED PRODUCT 2720353:2721114 FORWARD MW: 27865 |
| SEQ ID NO: 251 | >2832 FRG__STAAU8325, UNDEFINED PRODUCT 2721229:2722446 FORWARD MW: 44105 |
| SEQ ID NO: 252 | >G2837 FRG__STAAU8325, UNDEFINED PRODUCT 2720004:2726816 REVERSE MW: 228019 |
| SEQ ID NO: 253 | LOCUS 52 (E1) >G0406 FRG__STAAU8325, UNDEFINED PRODUCT 370166:372094 REVERSE MW: 70979 |
| SEQ ID NO: 254 | >G0407 FRG__STAAU8325, UNDEFINED PRODUCT 372110:372754 REVERSE MW: 23024 |
| SEQ ID NO: 255 | LOCUS 53 (E20) >G2244 FRG__STAAU8325, UNDEFINED PRODUCT 2142042:2143301 REVERSE MW: 46800 |
| SEQ ID NO: 256 | >G2245__STAAU8325, UNDEFINED PRODUCT 2143358:2144242 REVERSE MW: 33683 |
| SEQ ID NO: 257 | >G2246__STAAU8325, UNDEFINED PRODUCT 2144245:2144799 REVERSE MW: 21063 |
| SEQ ID NO: 258 | >G2247 FRG__STAAU8325, UNDEFINED PRODUCT 2144813:2146015 REVERSE MW: 46577 |
| SEQ ID NO: 259 | LOCUS 54 (E105) >G2254 FRG__STAAU8325, UNDEFINED PRODUCT 2152390:2153505 REVERSE MW:42140 |
| SEQ ID NO: 260 | >G2255__STAAU8325, UNDEFINED PRODUCT 2153408:2155321 REVERSE MW: 72361 |
| SEQ ID NO: 261 | >G2256__STAAU8325, UNDEFINED PRODUCT 2155251:2156012 REVERSE MW: 29362 |
| SEQ ID NO: 262 | LOCUS 55 (E18) >G2912 FRG__STAAU8325, UNDEFINED PRODUCT 2797518:2798504 FORWARD MW: 37832 |
| SEQ ID NO: 263 | LOCUS 56 (F5) >G1261 FRG__STAAU8325, UNDEFINED PRODUCT 1216923:1217903 FORWARD MW: 36061 |
| SEQ ID NO: 264 | >G1262__STAAU8325, UNDEFINED PRODUCT 1217919:1219190 FORWARD MW: 46726 |
| SEQ ID NO: 265 | >G1263__STAAU8325, UNDEFINED PRODUCT 1219532:1219978 FORWARD MW: 16676 |
| SEQ ID NO: 266 | >G1264__STAAU8325, UNDEFINED PRODUCT 1219995:1220972 FORWARD MW: 36973 |
| SEQ ID NO: 267 | LOCUS 57 (F3) >G0451__STAAU8325, UNDEFINED PRODUCT 410768:412549 FORWARD MW: 67976 |
| SEQ ID NO: 268 | >G0452__STAAU8325, UNDEFINED PRODUCT 412872:414536 FORWARD MW: 60909 |
| SEQ ID NO: 269 | LOCUS 58 (G8) >G0922 FRG__STAAU8325, UNDEFINED PRODUCT 915062:915931 REVERSE NW: 33411 |
| SEQ ID NO: 270 | >G0923__FRG STAAU8325, UNDEFINED PRODUCT 915950:918577 REVERSE NW: 99163 |
| SEQ ID NO: 271 | LOCUS 59 (G23) >G2454 FRG__STAAU8325, UNDEFINED PRODUCT 2344101:2344937 REVERSE MW: 32360 |
| SEQ ID NO: 272 | >G2455__STAAU8325, UNDEFINED PRODUCT 2345162:2346508 REVERSE MW: 51133 |
| SEQ ID NO:273 | LOCUS 60 (G29) G0139__FRG STAAU8325, UNDEFINED PRODUCT 137065:137352 REVERSE MW: 11080 |
| SEQ ID NO: 274 | >NONE, UNDEFINED PRODUCT 137582:139645 REVERSE MW: 75349 |
| SEQ ID NO: 275 | LOCUS 61 (G28/HA7) >G2610__FRG STAAU8325, UNDEFINED PRODUCT 2494989:2495441 FORWARD MW: 17293 |
| SEQ ID NO: 276 | G2611__STAAU8325, UNDEFINED PRODUCT 2495615:2497207 REVERSE MW: 58937 |
| SEQ ID NO: 277 | LOCUS 62 (H3) >G2004__STAAU8325, UNDEFINED PRODUCT 1871545:1872954 REVERSE MW: 51401 |
| SEQ ID NO: 278 | LOCUS 63 (GD10) >G2900__FRG STAAU8325, UNDEFINED PRODUCT 2781950:2783308 FORWARD MW: 51966 |
| SEQ ID NO: 279 | >G2901__STAAU8325, UNDEFINED PRODUCT 2783589:2784719 FORWARD MW: 41914 |
| SEQ ID NO: 280 | LOCUS 64 (F5) >G1261 FRG__STAAU8325, UNDEFINED PRODUCT 1216923:1217903 FORWARD MW: 36061 |

TABLE 8-continued

| | |
|---|---|
| SEQ ID NO: 281 | >G1262__STAAU8325, UNDEFINED PRODUCT 1217919:1219190 FORWARD MW: 46726 |
| SEQ ID NO: 282 | >G1263__STAAU8325, UNDEFINED PRODUCT 1219532:1219978 FORWARD MW: 16676 |
| SEQ ID NO: 283 | >G1264__STAAU8325, UNDEFINED PRODUCT 1219995:1220972 FORWARD MW: 36973 |
| SEQ ID NO: 284 | LOCUS 65 (F110) >G2848__STAAU8325, UNDEFINED PRODUCT 2734525:2735082 REVERSE MW: 21969 |
| SEQ ID NO: 285 | >G2849__STAAU8325, UNDEFINED PRODUCT 2735246:2736481 FORWARD MW: 47752 |
| SEQ ID NO: 286 | >G2850__STAAU8325, UNDEFINED PRODUCT 2736448:2736750 FORWARD MW: 11783 |
| SEQ ID NO: 287 | >G2851__STAAU8325, UNDEFINED PRODUCT 2736729:2737619 FORWARD MW: 34958 |
| SEQ ID NO: 288 | >G2852__STAAU8325, UNDEFINED PRODUCT 2737609:2738658 FORWARD NW: 41344 |
| SEQ ID NO: 289 | >G2853__FRG STAAU8325, UNDEFINED PRODUCT 2739111:2741162 REVERSE MW: 77120 |
| SEQ ID NO: 290 | LOCUS 66 (E1) >G0406__STAAU8325, UNDEFINED PRODUCT 370166:372094 REVERSE MW: 70979 |
| SEQ ID NO: 291 | >G0407__STAAU8325, UNDEFINED PRODUCT 372110:372754 REVERSE MW: 23024 |
| SEQ ID NO: 292 | LOCUS 67 (F119) >G1831 FRG__STAAU8325, UNDEFINED PRODUCT 1723090:1723806 REVERSE MW: 27770 |
| SEQ ID NO: 293 | >G1832__STAAU8325, UNDEFINED PRODUCT 1724158:1725096 REVERSE MW: 34671 |
| SEQ ID NO: 294 | >G1834__STAAU8325, UNDEFINED PRODUCT 1725193:1725327 REVERSE MW: 5264 |
| SEQ ID NO: 295 | >G1835__STAAU8325, UNDEFINED PRODUCT 1725449:1726531 REVERSE MW: 40775 |
| SEQ ID NO: 296 | >G1837__STAAU8325, UNDEFINED PRODUCT 1726810:1727562 REVERSE MW: 28926 |
| SEQ ID NO: 297 | LOCUS 68 (G27) >G0516__STAAU8325, UNDEFINED PRODUCT 482272:486557 REVERSE MW: 163057 |
| SEQ ID NO: 298 | LOCUS 69 (H110) >G2217 FRG__STAAU8325, UNDEFINED PRODUCT 2108154:2110211 FORWARD MW: 74420 |
| SEQ ID NO: 299 | LOCUS 70 >G1778__STAAU8325, UNDEFINED PRODUCT 1669401:1669715 REVERSE MW: 11597 |
| SEQ ID NO: 300 | >01780__STAAU8325, UNDEFINED PRODUCT 1669808:1671502 REVERSE MW: 63481 |
| SEQ ID NO: 301 | >G1781__STAAU8325, UNDEFINED PRODUCT 1671574:1672095 REVERSE MW: 19908 |
| SEQ ID NO: 302 | >G1782__STAAU8325, UNDEFINED PRODUCT 1672236:1672334 REVERSE MW: 3948 |
| SEQ ID NO: 303 | >01783__STAAU8325, UNDEFINED PRODUCT 1672737:1673480 REVERSE MW: 28585 |
| SEQ ID NO: 304 | LOCUS 71 >G1083__STAAU8325, UNDEFINED PRODUCT 1057165:1058778 REVERSE MW: 57664 |
| SEQ ID NO: 305 | LOCUS 72 >02296__STAAU8325, UNDEFINED PRODUCT 2195143:2196150 REVERSE MW: 37749 |
| SEQ ID NO: 306 | >G2297__STAAU8325, UNDEFINED PRODUCT 2196150:2197127 REVERSE MW: 35879 |
| SEQ ID NO: 307 | LOCUS 73 >G2599__STAAU8325, UNDEFINED PRODUCT 2484215:2486668 REVERSE MW: 91038 |
| SEQ ID NO: 308 | LOCUS 74 >G1438__STAAU8325, UNDEFINED PRODUCT 1399373:1401364 REVERSE MW: 74364 |
| SEQ ID NO: 309 | >G1439__STAAU8325, UNDEFINED PRODUCT 1401364:1402104 REVERSE MW: 28046 |
| SEQ ID NO: 310 | LOCUS 75 >G0364__STAAU8325, UNDEFINED PRODUCT 331693:334395 REVERSE MW: 98970 |
| SEQ ID NO: 311 | LOCUS 76 >G2434__STAAU8325, UNDEFINED PRODUCT 2324870:2325844 REVERSE MW: 37506 |
| SEQ ID NO: 312 | >G2435__STAAU8325, UNDEFINED PRODUCT 2326069:2327847 REVERSE MW: 68170 |
| SEQ ID NO: 313 | LOCUS 77 >G2617__STAAU8325, UNDEFINED PRODUCT 2501985:2502917 REVERSE MW: 34781 |
| SEQ ID NO: 314 | LOCUS 78 |
| SEQ ID NO: 315 | LOCUS 79 >G1981__STAAU8325, UNDEFINED PRODUCT 1853885:1855240 REVERSE MW: 50053 |
| SEQ ID NO: 316 | >G1982__STAAU8325, UNDEFINED PRODUCT 1855258:1856436 REVERSE NW: 44485 |
| SEQ ID NO: 317 | >G1983__STAAU8325, UNDEFINED PRODUCT 1856643:1857842 FORWARD MW: 44601 |
| SEQ ID NO: 318 | LOCUS 80 MEROZOITE SURFACE ANTIGEN |
| SEQ ID NO: 319 | SURFACE PROTEIN |
| SEQ ID NO: 320 | LOCUS 81 G0745 |
| SEQ ID NO: 321 | G0746 |
| SEQ ID NO: 322 | LOCUS 82 G1333 |
| SEQ ID NO: 323 | G1334 |

TABLE 8-continued

| | |
|---|---|
| SEQ ID NO: 324 | LOCUS 83 G2364 |
| SEQ ID NO: 325 | LOCUS 84 G2820 |
| SEQ ID NO: 326 | LOCUS 85 >G0455__STAAU8325, UNDEFINED PRODUCT 416425:417609 REVERSE MW: 43472 |
| SEQ ID NO: 327 | LOCUS 86 >G2379__STAAU8325, UNDEFINED PRODUCT 2264977:2265987 REVERSE MW: 37179 |
| SEQ ID NO: 328 | G2378__STAAU8325, UNDEFINED PRODUCT 2263914:2264921 REVERSE MW: 36281 |
| SEQ ID NO: 329 | LOCUS 87 >G1472__STAAU8325, UNDEFINED PRODUCT 1435745:1436533 REVERSE MW: 30166 |
| SEQ ID NO: 330 | LOCUS 88 >G2206__STAAU8325, UNDEFINED PRODUCT 2093451:2094926 REVERSE MW: 55558 |
| SEQ ID NO: 331 | >G2205__STAAU8325, UNDEFINED PRODUCT 2092282:2093451 REVERSE MW: 43439 |
| SEQ ID NO: 332 | >G2204__STAAU8325, UNDEFINED PRODUCT 2090490:2092262 REVERSE MW: 66992 |
| SEQ ID NO: 333 | >G2203__STAAU8325, UNDEFINED PRODUCT 2088446:2090449 REVERSE MW: 74694 |
| SEQ ID NO: 334 | LOCUS 89 >G0815__STAAU8325, UNDEFINED PRODUCT 808746:808916 REVERSE MW: 6481 |
| SEQ ID NO: 335 | >G0816__STAAU8325, UNDEFINED PRODUCT 807493:808986 FORWARD MW: 56448 |
| SEQ ID NO: 336 | >G0817__STAAU8325, UNDEFINED PRODUCT 809084:809941 REVERSE MW: 31551 |
| SEQ ID NO: 337 | >G0818__STAAU8325, UNDEFINED PRODUCT 810088:810282 FORWARD MW: 7657 |
| SEQ ID NO: 338 | LOCUS 92 >G2378__STAAU8325, UNDEFINED PRODUCT 2263914:2264921 REVERSE MW: 36281 |
| SEQ ID NO: 339 | >G2379__STAAU8325, UNDEFINED PRODUCT 2264977:2265987 REVERSE MW: 37179 |
| SEQ ID NO: 340 | LOCUS 93 >G2768__STAAU8325, UNDEFINED PRODUCT 2548049:2649509 FORWARD MW: 52382 |
| SEQ ID NO: 341 | LOCUS 94 >G2374__STAAU8325, UNDEFINED PRODUCT 2260182:2261696 REVERSE MW: 56424 |
| SEQ ID NO: 342 | >G2375__STAAU8325, UNDEFINED PRODUCT 2261702:2262559 REVERSE MW: 30982 |
| SEQ ID NO: 343 | LOCUS 95 >G2535__STAAU8325, UNDEFINED PRODUCT 2417067:2417516 FORWARD MW: 16668 |
| SEQ ID NO: 344 | >G2537__STAAU8325, UNDEFINED PRODUCT 2417664:2419181 REVERSE MW: 55776 |
| SEQ ID NO: 345 | G2538? LOCUS 96 >G2914__STAAU8325, UNDEFINED PRODUCT 2799733:2801715 FORWARD MW: 74379 |
| SEQ ID NO: 346 | LOCUS 97 >G0929__STAAU8325, UNDEFINED PRODUCT 926398:927756 FORWARD MW: 50481 |
| SEQ ID NO: 347 | >G0930__STAAAA8325, UNDEFINED PRODUCT 927795:928619 REVERSE NW: 32642 |
| SEQ ID NO: 348 | >G0931__STAAU8325, UNDEFINED PRODUCT 928619:929443 REVERSE MW: 32667 |
| SEQ ID NO: 349 | >G0932__STAAU8325, UNDEFINED PRODUCT 930087:931841 REVERSE MW: 63103 |
| SEQ ID NO: 350 | LOCUS 98 >G2804__STAAU8325, UNDEFINED PRODUCT 2682166:2682924 REVERSE MW: 29096 |
| SEQ ID NO: 351 | >G2805__STAAU8325, UNDEFINED PRODUCT 2683043:2685673 REVERSE MW: 93576 |
| SEQ ID NO: 352 | LOCUS 99 >G2284__STAAU8325, UNDEFINED PRODUCT 2182330:2183307 REVERSE MW: 37252 |
| SEQ ID NO: 353 | >G2285__STAAU8325, UNDEFINED PRODUCT 2183380:2183499 REVERSE MW: 4917 |
| SEQ ID NO: 354 | >G2286__STAAU8325, UNDEFINED PRODUCT 2183646:2184428 REVERSE MW: 27575 |
| SEQ ID NO: 355 | LOCUS 100 >G1465__STAAU8325, UNDEFINED PRODUCT 1429687:1432446 REVERSE MW: 105241 |
| SEQ ID NO: 356 | LOCUS 101 (GF7) >G1243__STAAU8325, UNDEFINED PRODUCT 1200372:1201841 FORWARD MW: 54782 |
| SEQ ID NO: 357 | LOCUS 102 >G2529 FRG__STAAU8325, UNDEFINED PRODUCT 2410504:2411484 REVERSE MW: 36804 |
| SEQ ID NO: 358 | >G2530__STAAU8325, UNDEFINED PRODUCT 2411492:2412409 REVERSE MW: 32919 |
| SEQ ID NO: 359 | >G2531 FRG__STAAU8325, UNDEFINED PRODUCT 2412999:2413832 REVERSE MW: 31735 |
| SEQ ID NO: 360 | LOCUS 103 (GF11) >G2235 FRG STAAU8325, UNDEFINED PRODUCT 2133494:2134471 REVERSE MW: 36941 |
| SEQ ID NO: 361 | >G2236__STAAU8325, UNDEFINED PRODUCT 2134482:2135219 REVERSE MW: 28095 |
| SEQ ID NO: 362 | LOCUS 104 (GF12) >G2828 FRG__STAAU8325, UNDEFINED PRODUCT 2715541:2717115 REVERSE MW: 59929 |
| SEQ ID NO: 363 | >G2829 FRG__STAAU8325, UNDEFINED PRODUCT 2717099:2718649 REVERSE MW: 61259 |

TABLE 8-continued

| | |
|---|---|
| SEQ ID NO: 364 | LOCUS 105 (E18) >G2912__FRG STAAU8325, UNDEFINED PRODUCT 2797518:2798504 FORWARD MW: 37832 |
| SEQ ID NO: 365 | LOCUS 106 (E101) >G1083 FRG__STAAU8325, UNDEFINED PRODUCT 1057165:1058778 REVERSE MW: 57664 |
| SEQ ID NO: 366 | LOCUS 107 (E110) >G0975__STAAU8325, UNDEFINED PRODUCT 975981:977042 REVERSE MW: 40300 |
| SEQ ID NO: 367 | LOCUS 108 (E125) >G2809__STAAU8325, UNDEFINED PRODUCT 2689308:2690324 REVERSE MW: 38103 |
| SEQ ID NO: 368 | >G2810__STAAU8325, UNDEFINED PRODUCT 2690351:2691583 REVERSE MW: 46915 |
| SEQ ID NO: 369 | LOCUS 109 (F101) >G1098 FRG__STAAU8325, UNDEFINED PRODUCT 1068360:1069841 REVERSE MW: 57928 |
| SEQ ID NO: 370 | >G1099__STAAU8325, UNDEFINED PRODUCT 1069993:1070940 REVERSE MW: 35500 |
| SEQ ID NO: 371 | >G1100__STAAU8325, UNDEFINED PRODUCT 1071126:1072409 REVERSE MW: 46849 |
| SEQ ID NO: 372 | >G1101__STAAU8325, UNDEFINED PRODUCT 1072584:1072829 REVERSE MW: 9040 |
| SEQ ID NO: 373 | LOCUS 110 (F113) >G1446__STAAU8325, UNDEFINED PRODUCT 1408055:1410469 REVERSE MW: 92806 |
| SEQ ID NO: 374 | LOCUS 111 G2820 >G2820__STAAU8325, UNDEFINED PRODUCT 2704341:2706197 FORWARD MW: 69253 |
| SEQ ID NO: 375 | G2821 >G2821__STAAU8325, UNDEFINED PRODUCT 2706470:2707033 REVERSE MW: 20989 |
| SEQ ID NO: 376 | LOCUS 112 >G1905__STAAU8325, UNDEFINED PRODUCT 1786046:1787398 REVERSE MW: 48776 |
| SEQ ID NO: 377 | >G1906__STAAU8325, UNDEFINED PRODUCT 1787508:1787924 REVERSE MW: 16172 |
| SEQ ID NO: 378 | LOCUS 113 G1111 >G1111__STAAU8325, UNDEFINED PRODUCT 1083909:1085690 FORWARD MW: 65093 |
| SEQ ID NO: 379 | G1112 >G1112__STAAU8325, UNDEFINED PRODUCT 1085693:1085944 FORWARD MW: 9621 |
| SEQ ID NO: 380 | G1113 >G1113__STAAU8325, UNDEFINED PRODUCT 1086069:1087085 FORWARD MW: 37588 |
| SEQ ID NO: 381 | LOCUS 114 G1542 >G1542 STAAU8325, UNDEFINED PRODUCT 1495403:1497337 FORWARD MW: 72192 |
| SEQ ID NO: 382 | G1543 >G1543__STAAU8325, UNDEFINED PRODUCT 1497540:1497668 REVERSE MW: 4973 |
| SEQ ID NO: 383 | G1544 >G1544__STAAU8325, UNDEFINED PRODUCT 1497751:1497846 REVERSE MW: 3849 |
| SEQ ID NO: 384 | G1546 >NONE, UNDEFINED PRODUCT 1497815:1498165 REVERSE MW: 12767 |
| SEQ ID NO: 385 | LOCUS 115 G2712 >NONE, UNDEFINED PRODUCT 2598712:2601288 REVERSE MW: 94980 |
| SEQ ID NO: 386 | G2713 >G2713__STAAU8325, UNDEFINED PRODUCT 2601346:2601891 FORWARD MW: 21879 |
| SEQ ID NO: 387 | G2714 >G2714__STAAU8325, UNDEFINED PRODUCT 2601974:2602138 REVERSE MW: 6456 |
| SEQ ID NO: 388 | G2715 >G2715__STAAU8325, UNDEFINED PRODUCT 2602253:2603800 REVERSE MW: 57130 |

TABLE 9

| | |
|---|---|
| SEQ ID NO: 389 | Table 9, Sequence 1 |
| SEQ ID NO: 390 | LOCUS 2 |
| SEQ ID NO: 391 | LOCUS 3 |
| SEQ ID NO: 392 | LOCUS 4 |
| SEQ ID NO: 393 | LOCUS 5 |
| SEQ ID NO: 394 | LOCUS 6 |
| SEQ ID NO: 395 | LOCUS 7 |
| SEQ ID NO: 396 | LOCUS 8 |
| SEQ ID NO: 397 | LOCUS 9 |
| SEQ ID NO: 398 | LOCUS 10 |
| SEQ ID NO: 399 | LOCUS 11 |
| SEQ ID NO: 400 | LOCUS 12 |

TABLE 10

| | |
|---|---|
| SEQ ID NO: 401 | LOCUS 1: ORF1 |
| SEQ ID NO: 402 | LOCUS 2: ORF1 |
| SEQ ID NO: 403 | LOCUS 2: ORF2 |
| SEQ ID NO: 404 | LOCUS 2: ORF3 |
| SEQ ID NO: 405 | LOCUS 3: OFR1 |
| SEQ ID NO: 406 | LOCUS 3: ORF2 |
| SEQ ID NO: 407 | LOCUS 3: ORF3 |
| SEQ ID NO: 408 | LOCUS 4: ORF1 |
| SEQ ID NO: 409 | LOCUS 4: ORF2 |
| SEQ ID NO: 410 | LOCUS 5: ORF1 |
| SEQ ID NO: 411 | LOCUS 5: ORF2 |
| SEQ ID NO: 412 | LOCUS 6: ORF1 |
| SEQ ID NO: 413 | LOCUS 6: ORF2 |
| SEQ ID NO: 414 | LOCUS 7: ORF1 |
| SEQ ID NO: 415 | LOCUS 7: ORF2 |
| SEQ ID NO: 416 | LOCUS 8: ORF1 |
| SEQ ID NO: 417 | LOCUS 9: ORF1 |
| SEQ ID NO: 418 | LOCUS 10: ORF1 |
| SEQ ID NO: 419 | LOCUS 10: ORF2 |
| SEQ ID NO: 420 | LOCUS 11: ORF1 |
| SEQ ID NO: 421 | LOCUS 11: ORF2 |
| SEQ ID NO: 422 | LOCUS 11: ORF3 |
| SEQ ID NO: 423 | LOCUS 12: ORF1 |
| SEQ ID NO: 424 | LOCUS 12: ORF2 |

SEQUENCE LISTING (424 sequences)

SEQ ID NO: 1 - DNA, 3692 bp, Staphylococcus aureus
gatcccgttgtgcttcacacccgatagatagggatttacagataaattcaggtctcttccacgtcatatttggacccatcgaaaattcgggttctcaaatcatcgaacataacaaaagaagctaagcaacatgtaggccgttgtcacttaacttcttgtttttccgatgacagcttctatttagagaatgtcatgattattttatattcacttcaatgttatcaatattagtgccatctatgacatctgccatgcgattttcttgtaattttttgtgcaattcaaacgtgtactttccaccgtttttcattttaataacaattttacctgaaccaacgttaccgtacagattatttttttcaataagttgttttctcaatttaaaatcaagttctttcaaggaaatctgttctttagtaatcttgaattctgaaacatcatgagagattgtacctttattatcttccttagtaattcttactcctgctttgtgatcaacttttttactattactctttgtgataccaccgacagaatatttttccagattgtaattattttcttctaaaacgacaaatacatcgacattcctatgtactccttcaccatattttttatcatctttaccaactaaagcaattttatatatgaaataatctgggacaacattcataaatcttattgtcgtccatttttttaaaataataccaatctcatttttaaattctaaacttggtttcgtataatacgctcttaaatctttaaatttaggatttatttctgttggtacttgttttgtggttggcgattgtggtgtgtctgatttagtagattgcattggttgtggcgtgtttgttgatggaggtgttgtcactttagttgaaggcggtgttgtcgcatttgctgtttgttgcggtgcttctactttagttgagggcggtgttgtcgcgtttggttttgattgcggtgcttctattttagttgagggcggtgttgattgtggtgcttccactttagtggaagatagtgttgtcgcgtttgctgcttgcgttgtcgttgtgattacacctgttgttaaaaggcctagtgctaaacttgttttagcaatcgttgttattttcatagttgtatgctccattcgtaattattagatttgttcgattacattcattgaatcatacagctttattatagatggcgtattgctccattcacattaaaccttgtttaactatatttgaatcatcgttaagtaaattaagaaatccataatgttcgttaaataaaaatgattttgatgtgattcaacacttggcacatttgaagtttcgtcacttttaagacatagaaatgccacttttacaaacaaatgaatattcgtctttttacatcattacgcataataaaagaagctaagcaacatgtaaaccgttgtcacttaacttcttgtttttccgatgacagcttctatttagagaatgtcatgattattttatattcacttcaatgttatcaatattagtgccatctatgacgtctgccatacgatgctcttgcagttttttgtgtaattcaaacgtatatttcccaccgtttttcattttaataacgattgttcctgaacccatgttaccgtaaagattatgtttttcaataagttgttttctcaatttaaaatcaagctctttcaaggaaatctcttccttagtaatcatgtattctgaaacatcgcgtgaaatcataccttgattatcttttttagtaatgcttaattctactttgtgattaacttttttactattagtcttcgtgatgccaccgacagaatattttttcaattgatatttattgtcttctaaaacgataaatacatcgatattatcgtaaggtccatctttatattttttctcatcttttccaactaaagctattttatagatgaacctatttggaataacattcataaacctaaccgtcgtccatggtttgagcataaatccaaactgcttttcaaattcaaaactcggttttgtataatacgctcttaaatcttcatatttaggagtcatatctgtttgtgcttgttttatggttggagattgtggtgtgtctgatttagtagattgcattggttgtggcgtgtttgttgatggaggtgttgtcactttagttttcggcgttgtggattcggttgtcgtttgtgattgttcttgtttaggcgctggcgttgctgatatattaagcgttttctgctcttcttgtttaggttgtgatattttttctattttggaagctgaggttttttcctcattagtatttggtgccttttcgagtttaggcgtgcgttcttgtcttgtgttagctgcttgtgttgtcgctgaatttgcacctgctgttatgtttatcattgctaatcgctctgctttaagcgttggtactttgtcaactttagttgattgtattttttctgctttgaccgattgcgtcgttactgtaattgcgcctgttgttaaaagccctagtgctaaactggttttagcaattgttctcattttcataattgtatgctccaatctatattatattcgattgtctttttacgtaatttgaatcatacaacatcattatagatggcgttctaagataatcacattaaaccccttttaacaattattgaagtattattaagtaatttaagcaaaaaataatgagtgagtatgagattaatatagcgtttctatgtgcctttgaaataatttttaagcattaaaaagaagttaagcaacgtttgatcgtcacttaacctctctatttcaatttcaacttatttcgtcatcaagtatatgtgttatgcttttataactttgatttcaattctatcaatatctgtgacattgataacatcggacatacggtcttcttgtaactttttatccaattcaaatgtatactttccatagtatttctttttgactgtaatttttcctgtactcatttcaccgtaaagaccataattatcaataaggtattttcttaatttaaaatcaatctctttcaatgacatcgcttctttatctattttaaatgggaaaaagtcataatcatattcaccagtatgatcttctttaataactcttgcttctgctattaggtcgacagctttatcgtttgcactcgtgatacccccaatagagtactttgcaccttcaaatctcttatcctcattaacgtaaaatatattaagattacgatgtacacccgtatgataatgttgcttatctttgccaattaaagcaatattattaacagaattaccatctatgatattcataaatttaatacttggttgaatgaaactgatataacctgtcacatttttatattcaatactaggttgattataataagcttttaattttttgctattttcacttattacaataggtttcttttcggcatgaactggtttttccgttgtagtgtttacacctgttgctaatattcctaataacaaacttatttttgcaatatttttcattttcatagttgtatgctccaatctattataattagattgttttattacgtaatttgaatcatacacccatattataggagctgtattcggatattcacattaacctgtttttaactattcataaaatatgattaagctatttaagcaaaagatc

SEQ ID NO: 2 - DNA, 3695 bp, Staphylococcus aureus
gatcaaactactaataaaaacgttttagatagtaataaagttaaagcaactactgaacaagcaaaagctgaggtaaaaaatccaacgcaaaacatttctggcactcaagtatatcaagaccctgctattgtccaaccaaaaacagcaaataacaaaacaggcaatgctcaagtaagtcaaaaagttgatactgcacaagtaaatggtgacactcgtgctaatcaatcagcgactacaaataatacgcagcctgttgcaaagtcaacaagcactacagcacctaaaactaacactaatgttacaaatgctggttatagtttagttgatgatgaagatgataattcagaaaatcaaattaatccagaattaattaaatcagctgctaaacctgcagctcttgaaacgcaatataaaaccgcagcacctaaagctgcaactacatcagcacctaaagctaaaactgaagcgacacctaaagtaactacttttagcgcttcagcacaaccaagatcagttgctgcaacaccaaaaacgagtttgccaaaatataaaccacaagtaaactcttcaattaacgattacatttgtaaaaataacttaaaagcacctaaaattgaagaagattatacatcttacttccctaaatacgcataccgtaacggcgtaggtcgtcctgaaggtatcgtagttcatgatacagctaatgatcgttcgacgataaatggtgaaattagttatatgaaaaataactatcaaaacgcattcgtacatgcatttgttgatggggatcgtataatcgaaacagcaccaacggattacttatcttggggtgtcggtgcagtcggtaaccctagattcatcaatgttgaaatcgtacacacacacgactatgcttcatttgcacgttcaatgaataactatgctgactatgcagctacacaattacaatattatggtttaaaaccagacagtgctgagtatgatggaaatggtacagtatggactcactacgctgtaagtaaatatttaggtggtactgaccatgccgatccacatggatatttaagaagtcataattatagttatgatcaattatatgacttaattaatgaaaaatatttaataaaaatgggtaaagtggcgccatggggtacgcaatctacaactacccctactacaccatcaaaaccaacaacaccgtcgaaaccatcaactggtaaattaacagttgctgcaaacaatggtgtcgcacaaatcaaaccaacaaatagtggtttatatactactgtatacgacaaaactggtaaagcaactaatgaagttcaaaaaacatttgctgtatctaaaacagctacattaggtaatcaaaaattctatcttgttcaagattacaattctggtaataaatttggttgggttaaagaaggcgatgtggtttacaacacagctaaatcacctgtaaatgtaaatcaatcatattcaatcaaacctggtacgaaactttatacagtaccttggggtacatctaaacaagttgctggtagtgtgtctggctctggaaaccaaacatttaaggcttcaaagcaacaacaaattgataaatcaatttatttatatggctctgtgaatggtaaatctggttgggtaagtaaagcatatttagttgatactgctaaacctacgcctacaccaacacctaagccatcaacacctacaacaaataataaattaacagtttcatcattaaacggtgttgctcaaattaatgctaaaaacaatggcttattcactacagtttatgacaaaactggtaagccaacgaaagaagttcaaaaaacatttgctgtaacaaaagaagcaagtttaggtggaaacaaattctacttagttaaagattacaatagtccaactttaattggttgggttaaacaaggtgacgttatttataacaatgcaaaatcacctgtaaatgtaatgcaaacatatacagtaaaaccaggcactaaattatattcagtaccttggggcacttataaacaagaagctggtgcagtttctggtacaggtaaccaaacttttaaagcgactaagcaacaacaaattgataaatctatctatttatttggaactgtaaatggtaaatctggttgggtaagtaaagcatatttagctgtacctgctgcacctaaaaaagcagtagcacaaccaaaaacagctgtaaaagcttatactgttactaaaccacaaacgactcaaacagttagcaagattgctcaagttaaaccaaacaacactggtattcgtgcttctgtttatgaaaaaacagcgaaaaacggtgcgaaatatgcagaccgtacgttctatgtaacaaaagagcgtgctcatggtaatgaaacgtatgtattattaaacaatacaagccataacatcccattaggttggttcaatgtaaaagacttaaatgttcaaaacttaggcaaagaagttaaaacgactcaaaaatatactgttaataaatcaaataacggcttatcaatggttccttggggtactaaaaaccaagtcattttaacaggcaataacattgctcaaggtacatttaatgcaacgaaacaagtatctgtaggcaaagatgtttatttatacggtactattaataaccgcactggttgggtaaatgcaaaagatttaactgcaccaactgctgtgaaaccaactacatcagctgccaaagattataactacacttatgtaattaaaaatggtaatggttattactatgtaacaccaaattctgatacagctaaatactcattaaaagcatttaatgaacaaccattcgcagttgttaaagaacaagtcattaatggacaaacttggtactatggtaaattatctaacggtaaattagcatggattaaatcaactgatttagctaaagaattaattaagtataatcaaacaggtatgacattaaaccaagttgctcaaatacaagctggtttacaatataaaccacaagtacaacgtgtaccaggtaagtggacagatgctaaatttaatgatgttaagcatgcaatggatacgaagcgtttagctcaagatccagcattaaaatatcaattcttacgcttagaccaaccacaaaatatttctattgataaaattaatcaattcttaaaaggtaaaggtgtattagaaaaccaaggtgctgcatttaacaaagctgctcaaatgtatggcattaatgaagtttatcttatctcacatgccctattagaaacaggtaacggtacttctcaattagcgaaaggtgcagatgtagtgaacaacaaagttgtaactaactcaaacacgaaataccataacgtatttggtattgctgcatatgataacgatcctttacgtgaaggtattaaatatgctaaacaagctggttgggacacagtatcaaaagcaatcgttggtggtgctaaattcatcggcaactcatatgtaaaagctggtcaaaatacactttacaaaatgagatggaatcctgcacatccaggaacacaccaatatgctacagatgtagattgggctaacatcaatgctaaaatcatcaaaggctactatgataaaattggcgaagtcggcaaatacttcgacatcccacaatataaataagcaacatgaacataggatcaaaagtc

SEQ ID NO: 3 - DNA, 4703 bp, Staphylococcus aureus
gatcgcaagccagttacagttgcagatttaaaagtggaaggtgcacttgcaatgattttaaaagatgcaataaaaccaaacttagtacaatcaattgaagggacacctgcattagttcatggtggaccatttgcgaatatcgcacacggttgtaactcaattttagcaactgaaacagcacgtgatttagctgatatcgttgtaacggaagctggatttggttcagacttaggcgctgaaaaattcatggacattaaagcgcgtgaagcaggatttgatccggcagctgtcgttgttgttgcgacaattcgtgcgttaaaaatgcatggtggtgtagcgaaagataatttaaaagaagaaaatgtagaagcagtaaaagcaggaattgttaatttagagcgtcatgttaataatattaaaaaattcggtgtagaaccggttgttgcaattaatgcatttatacatgataccgatgcagaagtagaatatgtaaaatcttgggctaaagaaaataacgtacgaattgccttaactgaagtttgggaaaaaggtggtaaaggtggcgttgacttagcaaatgaagtattagaagtcattgatcaacctaattcatttaaacctttatatgaattagaattaccattagagcaaaagattgaaaagattgtgactgaaatctatggcggttcaaaagtaacgtttagcagtaaagcgcaaaaacaattaaaacaatttaaagaaaatggttgggataattacccagtatgtatggcgaaaacacaatattcattctcagatgatcaaacgttgttaggtgcaccatcaggatttgaaattacaattcgtgaattagaagcgaaaacaggtgcaggatttatcgtagcgttgacaggtgcaatcatgactatgcctggtttacctaaaaaaccagcagcattaaacatggatgttactgatgatggtcatgcaattgggttattctaataaatcatgtcaattgtttaataaagataagtaaatagtttaatagaccggactgttggagatgcattatttcagcagttcggttttttgctgtgctaaaaatagattcaatttggcgaatctaacgacaatgtttgaaggtggttaattaatgtatatgaagataaaaagtgggcttgaagaataggaaagcgatgcaatgaatattccatattaaaaaaaattaataaaataggttgcaatatttaattgggatgcgctacaattaacactaataattgatattgataattattatcaattaaatataatcttataggagttgttaacaacatgaacaaacatcacccaaaattaaggtctttctattctattagaaaatcaactctaggcgttgcatcggtcattgtcagtacactatttttaattacttctcaacatcaagcacaagcagcagaaaatacaaatacttcagataaaatctcggaaaatcaaaataataatgcaactacaactcagccacctaaggatacaaatcaaacacaacctgctacgcaaccagcaaacactgcgaaaaactatcctgcagcggatgaatcacttaaagatgcaattaaagatcctgcattagaaaataaagaacatgatataggtccaagagaacaagtcaatttccagttattagataaaaacaatgaaacgcagtactatcactttttcagcatcaaagatccagcagatgtgtattacactaaaaagaaagcagaagttgaattagacatcaatactgcttcaacatggaagaagtttgaagtctatgaaaacaatcaaaaattgccagtgagacttgtatcatatagtcctgtaccagaagaccatgcctatattcgattcccagtttcagatggcacacaagaattgaaaattgtttcttcgactcaaattgatgatggagaagaaacaaattatgattatactaaattagtatttgctaaacctatttataacgatccttcacttgtaaaatcagatacaaatgatgcagtagtaacgaatgatcaatcaagttcagtcgcaagtaatcaaacaaacacgaatacatctaatcaaaatatatcaacgatcaacaatgctaataatcaaccgcaggcaacgaccaatatgagtcaacctgcacaaccaaaatcgtcaacgaatgcagatcaagcgtcaagccaaccagctcatgaaacaaattctaatggtaatactaacgataaaacgaatgagtcaagtaatcagtcggatgttaatcaacagtatccaccagcagatgaatcactacaagatgcaattaaaaacccggctatcatcgataaagaacatacagctgataattggcgaccaattgattttcaaatgaaaaatgataaaggtgaaagacagttctatcattatgctagtactgttgaaccagcaactgtcatttttacaaaaacaggaccaataattgaattaggtttaaagacagcttcaacatggaagaaatttgaagtttatgaaggtgacaaaaagttaccagtcgaattagtatcatatgattctgataaagattatgcctatattcgtttcccagtatctaatggtacgagagaagttaaaattgtgtcatctattgaatatggtgagaacatccatgaagactatgattatacgctaatggtctttgcacagcctattactaataacccagacgactatgtggatgaagaaacatacaatttacaaaaattattagctccgtatcacaaagctaaaacgttagaaagacaagtttatgaattagaaaaattacaagagaaattgccagaaaaatataaggcggaatataaaaagaaattagatcaaactagagtagagttagctgatcaagttaaatcagcagtgacggaatttgaaaatgttacacctacaaatgatcaattaacagatttacaagaagcgcattttgttgtttttgaaagtgaagaaaatagtgagtcagttatggacggctttgttgaacatccattctatacagcaactttaaatggtcaaaaatatgtagtgatgaaaacaaaggatgacagttactggaaagatttaattgtagaaggtaaacgtgtcactactgtttctaaagatcctaaaaataattctagaacgctgattttcccatatatacctgacaaagcagtttacaatgcgattgttaaagtcgttgtggcaaacattggttatgaaggtcaatatcatgtcagaattataaatcaggatatcaatacaaaagatgatgatacatcacaaaataacacgagtgaaccgctaaatgtacaaacaggacaagaaggtaaggttgctgatacagatgtagctgaaaatagcagcactgcaacaaatcctaaagatgcgtctgataaagcagatgtgatagaaccagagtctgacgtggttaaagatgctgataataatattgataaagatgtgcaacatgatgttgatcatttatccgatatgtcggataataatcacttcgataaatatgatttaaaagaaatggatactcaaattgccaaagatactgatagaaatgtggataaagatgccgataatagcgttggtatgtcatctaatgtcgatactgataaagactctaataaaaataaagacaaagtcatacagctgaatcatattgccgataaaaataatcatactggaaaagcagcaaagcttgacgtagtgaaacaaaattataataatacagacaaagttactgacaaaaaaacaactgaacatctgccgagtgatattcataaaactgtagataaaacagtgaaaacaaaagaaaaagccggcacaccatcgaaagaaaacaaacttagtcaatctaaaatgctaccaaaaactggagaaacaacttcaagccaatcatggtggggcttatatgcgttattaggtatgttagctttattcattcctaaattcagaaaagaatctaaataattaactaaatatagcatatgtatgattaactttgtagacaatgtgaaagcaattaatttataaactattgattggtttaatggctttcctttagagtaaataaaaagaacagcagtgagaaattttctaattgaaaataatcttactgctgtttttaatatttggattcattgttgtggttactttaaaaagtgagcatcaattaacgcttttttcgatttaacaaatgtgatttaatatcatattttaatgcgtcgttgtattctttttcagtgatttgatcttcgattaacatacgctttaatacataatgttgtctttgaatactatatttcaaatctttatccgattttaacgttccatctttttcgtagggtgtatagccatatgggctttgcaacaaaccgataaggtatgcagattgtgcaattgataaatcttttggtggaataccaaatagactatatgaagcggatgcaattccggaaatattagcgccattataatctctaccgaagggaactatatttaaatatgtatatataatttcatcttttgagagtaggtgttctaatctaattgctaggcgaagttcatttgcttttctactatatgttttttcgttggtaagaacttgatttttaacaagttgttgtgtaattgtgctaccacctgaactttgatcagtattaaaaata

SEQ ID NO: 4 - DNA, 5690 bp, Staphylococcus aureus
caaagttaatgtgctccttttcctaagtattaaatctatgtatcaacgtcattttaacactaattagaacgccttcatagtgtcattgagtatgtaattatttcttgggaaatttgttttaattttaaaaaacaggcttacttcatataatttatgaaataaacctgtcaattttggattgattatgctttgtgattctttttatttctgcgtaataacgctaaacctaaaatgctaaataatccgccgaacaacatgccgttgtttgttgattcttctccacctgtttcaggtagttcagatttcttagattgtgcttttttagttggtaccactgctttaaccttttcattgatttcaataacaggtgttactactttaccttgttccactggtttagaaggttttttaggttcttctttagcaggtggtattggtttaccaggttcagttggtacctctggcgttggcggtgttggtgtttccggctcgcttggtacttctggtgtcggtggtgttggtgtttccggctcgcttggtacttctggtgtcggtggcgttggtggcacgattggaggtgttgtatcttcttcaatcgtttgttgaccttcattatgaccacttacttgtggaagtgtatcttcttcaaagtcaacactattgtgtccaccgaattgataatttggtttatctttatttgtatcttcttcaataatttcagtgtgcttattgaatccgtgaatatgtggcacactgtcgaagtcgatatcaatgatattaccaccttgttcatacttaggtttgtctttctctgtatcttcttcgaatgattggttaccattattttgaccatgaatttgaggtacactatcgaaatcgatatctacgatattgccaccttgttcatatttcggtttatcttcttctgtgtcttcctcaaatgactgattaccgctattttggccaccttcgtaacctaattcactcttaatatccacgtggctattttcttcgatttcttcaatcacgccataattaccgtgaccattttcagttcctaaaccagaatgagaaatatgatgattgttttcagtaatttcctcgattggtccttgcgcttgaccatgttcttcaggtagttcatctactagttcaatcagattactttcagtcgtatattctttcgtatcttcaattgttgtatgatcgctaacagcaccagttacaataccttttgtagaatcttcgtcaaattcaactaggttagactcagtagtaacctgaccaccacctgggtttgtatcttcttcatattcaacaacatcagcatgatgttttgaattttcatgtgtcgattcttcaaagtctacatgaatagaatcttcttcagtttcaatggtaccttctgcatgaccttctgcaccttcaacagctgtatgatattcaaaatcaattggcttagaatcattactttcttcgattgtaccagtcaattcatgcttctccactggcggctctgatttaaattcaagttcgataggagtactatgttctataataggttcctttagtttatctttgccgtcgccttgagcgttattagagtaaaatgcaacgccatttttccaagttaaattacttgtataataatagttataatatccaaaaaggtgtgtttgaaattctaagttgctagcatttgaatcataatacccttcatattttattacataatttttactttggtctaaattattaaagtttaaagaataaccaccattagtatcaaaatctaaactcatattatcagtcacatcttcaaatttgctgacatcatcaagctttgcatatacgctttcagctaaatcgtctgaaccaatgtgtttatataccttaactgttggattattaacccctggtttatttcctttagttacttgaccagttactgtcacagagcttaacgactggttgttaggtttcatgtacgcaaaatgactaaatttcccatctactttatttaaagtatcaattcgaccattagctgttactccccaattatctctaactccacctaaatattgaatattaaatattttgctaaccgtagtctcacccaatttaacttcaacattttggttacctttttgcgtcactgttgtaggatcaataaatagatttaaagataattcagcagttaaatctttcttttcttgtacatattctttaaacgtatatctaacttttctttctccaattatttctcctgtcgccataacttgaccatctgtactttttatctccggaactttacgcagtgttgagataccatgagtttcaacattatcgcttaatgtgaaatcaaaataatctcccgccttaattccttctccaaatttccatttatatttcaaggttactctttctgcgttatgaggatttacaacattcgtatcttgtttatgtcctacaatttcactaccttcttctacttccactttatttgttacatctgtacctgtcgctttagtttcttccactacttctttctctgcaactgctgtaacgtcagttgatcttttcattcttggtttaatttctgagacgttacttggttgagctatgtcaacttgagttcctgtagtttccttatcagcaactttttccgatggcaaatcaactcgcgaagtttctacttttggtgcttgcacagttttcggtgcttcttctgttgttacttgtgttgattgtgatggttgctcagttgatgtcgcgctgtatgattgtgtttcatctattgtattaacgttatttgtagttgtttgtgtttcgcttgctttactttcagtagctgaactcccactttcctctactgtagtattgttttgttccgatgctgcagcttctttttcttgtcccattccaacaacgatcattgttcctaagaatactgaggccgctcccaatttgtgttttcttatgccgtatctaagattgcttttcactataatattctcccttaaatgcaaaattcatttatttttaaaactcaataaatgcaattctatattgttcggtttttaaaagcaatgaaaaaaagcgagttaataaaaagttaagattgttgttaactttatgtataatgagttttttattatttgaaactcacatatatattgcatacaaagctcttgaacaccttgatataacaggcttgtattttttatacttactttttaaattaaattcaaattcatctaatttaaaacaatatactaaaccatacataataatcgcctgtacaatgcatcattaacaagtcactgaaacgcctttcattgtattaataacgtcactataatttttatatcgttcggtttttgtttgattttaatgattatttatacaaaaacagccgtatttcaagccgacattttaaatttaactaaatttgcatctagttaataattgcatttatcaaatttgtcttattgatccaatctaatttgtactcacaaactagtttaaaattctaactttatctctcagttcgttatcaatcatcagacataaaccaatgaagcaatcagaaaacactctaattttctattagaaatttgatttaatataaaaaaacaggcttacttcatataatttatgaaataaacccgtcaatttttgtttaattatgctttgtgattctttttatttctgcgtaataatgctaaacctagaatgctgaataatccgccgaacaacatacctttgtttgttgattcttctccacctgtttcaggtagttcagatttcttagattgtggttttttagttggtgccactgctttaaccttttcattgatttcaataacaggtgttactactttaccttgttccactggtttagaaggctttttaggttcttctttggcaggtggtactggtttaccaggttcagctggtacctctggtgttggcggtgttggagtttctggctcactcggcacttctggtgtcggtggtgttggtgtttccggctcacttggtacttctggtgttggtggcgttggtgtttccggctcacttggtacttctggtgtcggtggcgttggtggcacgattggaggtgttgtatcttcttcaatcgtttgttgaccttcattttggccgcttacttttggaagtgtatcttcttcaaagtcaacactattgtgtccaccgaattgataacttggtttatctttatttgtatcttcttcaataatttcagtgtgcttattgaatccgtgaatatgtggcacactgtcgaagtcgatatcaatgatgttaccgccatgttcatacttaggtttgtctttttctgtatcttcctcgaatgactgattacctttattttgaccatgaatttgaggtacactatcaaaatcgatatctacgatattgccaccttgttcatatttaggtttgtcttcttctgtgtcttcctcgaatgactggttaccgctattttggccaccttcataacctaattcactcttaatatcaacgtggctattttcttcgatttcttcaatcacgtcataattcccgtgaccattttcagttcctaaaccagaatgagaaatatgatgattgtttttagtaatttcctcgactggtccttgtgcttgaccatgctcttcaggtaattcatccactaattcaatcagattactttcagttgtatattctttcgtatcttcaactgttgtatgatcgctcactgcgccagttacaataccttttgtagactcttcgtcaaattcaactaagttagactcagtagtaacctgaccaccacctgggtttgtatcttcttcatattcaacaacatcagcgtgatgttttgaattttcatgtgtagattcttcaaagtcaattggatttgattcctcagaggactcagtgtatcctccaacgtgacctgcttcgctatccacagcagtatggtaatcgatatcaatagctgatgaatccgtttcttctattgtttcaatgtatccatcaacatatccacctccaccatctatagctgtgtggtaatcaatgtcaagagttgatgaatcatattcctcttcaacagtagttactaaattcttatcatattgacctgtaagagtttctttaattgtatcttctttatattcaaatttattattttgaataatcggaccatttttctcatttccgttcgctttattactgtataaaactaaaccattatcccaagttaaggtatatcctctatcataataatacttataaagttgctctggatgtcctaccatttgtgttctaaaatcaacttcatcagtaccatttaaatactctccatcatagtgaacaacataagttttatctagattttctatattcaatgaatagcttccattattttgtaaattcaaattcccactcatattacttgtgacttctttaaatttagaagtatctgtcgtatttgcatatacactcttcgctatgtcttcattattacccaagtattcaaatatcctaacttttggttgatttccattctgattactacctttcattaaagttccagtaacagtcacacttgtcgttttaccattattaggtttaataaatgcaacatgcgaaaatctattattcgctttattaaatgtctcaat

SEQ ID NO: 5 - DNA, 3704 bp, Staphylococcus aureus
gatcaacaaaaagctttttatcaagtattacatctaaaaggtatcacagaagaacaacgtaaccaatacatcaaaacattacgcgaacacccagaacgtgcacaagaagtattctctgaatcacttaaagacagcaagaacccagaccgacgtgttgcacaacaaaacgctttttacaatgttcttaaaaatgataacttaactgaacaagaaaaaaataattacattgcacaaattaaagaaaaccctgatagaagccaacaagtttgggtagaatcagtacaatcttctaaagctaaagaacgtcaaaatattgaaaatgcggataaagcaattaaagatttccaagataacaaagcaccacacgataaatcagcagcatatgaagctaactcaaaattacctaaagatttacgtgataaaaacaaccgctttgtagaaaaagtttcaattgaaaaagcaatcgttcgtcatgatgagcgtgtgaaatcagcaaatgatgcaatctcaaaattaaatgaaaaagattcaattgaaaacagacgtttagcacaacgtgaagttaacaaagcacctatggatgtaaaagagcatttacagaaacaattagacgcattagttgctcaaaaagatgctgaaaagaaagtggcgccaaaagttgaggctcctcaaattcaatcaccacaaattgaaaaacctaaagtagaatcaccaaaagttgaagtccctcaaattcaatcaccaaaagttgaggttcctcaatctaaattattaggttactaccaatcattaaaagattcatttaactatggttacaagtatttaacagatacttataaaagctataaagaaaaatatgatacagcaaagtactactataatacgtactataaatacaaaggtgcgattgatcaaacagtattaacagtactaggtagtggttctaaatcttacatccaaccattgaaagttgatgataaaaacggctacttagctaaatcatatgcacaagtaagaaactatgtaactgagtcaatcaatactggtaaagtattatatactttctaccaaaacccaacattagtaaaaacagctattaaagctcaagaaactgcatcatcaatcaaaaatacattaagtaatttattatcattctggaaataatcaatcaaaaatatcttctctagttttacatcattttttaaataattttcgtaacaaaccgtgattaaaaagaaccgttgattctcaatcgaatctacggttcttttttcattttccatcaattaaatgcttcttcgctatttgtcagcccacttttttacctgcaacttgttaaataatccttacatcgttaacgaatagttcatcatttagttgaatcagctcaactttattaacttcatattttcacaaactattgcgcaatccattccttttccactacaagcaccataattaaacaacaattcaataaaataagacttgcaaagcatagttatgtagctatataaacgcctgcgaccaataaatcttttaaacataacataatgcaaaaacatcatttaacaatgctaaaaatgtctcttcaatacatgttgatagtaattaacttttaacgaacagttaattcgaaaacgcttacaaatggattattatatatatgaacttaaaattaaatagaaagaaagtgatttctatgattaaaaataaaatattaacagcaactttagcagttggtttaatagcccctttagccaatccatttatagaaatttctaaagcagaaaataagatagaagatatcggccaaggtgcagaaatcatcaaaagaacacaagacattactagcaaacgattagctataactcaaaacattcaatttgattttgtaaaagataaaaaatataacaaagatgccctagttgttaagatgcaaggcttcattagctctagaacaacatattcagacttaaaaaaatatccatatattaaaagaatgatatggccatttcaatataatatcagtttgaaaacgaaagactctaatgttgatttaattaattatcttcctaaaaataaaattgattcagcagatgttagtcagaaattaggctataatatcggcggaaacttccaatcagcgccatcaatcggaggcagtggctcattcaactactctaaaacaattagttataatcaaaaaaactatgttactgaagtagaaagtcagaactctaaaggtgttaaatggggagtgaaagcaaattcattcgttacaccgaatggtcaagtatctgcatatgatcaatacttatttgcacaagacccaactggtccagcagcacgagactatttcgtcccagataatcaactacctcctttaattcaaagtggctttaatccatcatttattacaacattgtcacacgaaagaggtaaaggtgataaaagcgagtttgaaatcacttacggcagaaacatggatgctacatatgcttacgtgacaagacatcgtttagccgttgatagaaaacatgatgcttttaaaaaccgaaacgttacagttaaatatgaagtgaactggaaaacacatgaagtaaaaattaaaagcatcacacctaagtaaacagttcaatcatcttaaaaaatcctgggacacttcatacttgtctcaggattttttaacaaattgaatcagcctcataacattaaattattttatcgtacattaaatttaataataacaactgatttttataagaataaagtatcgaaccatagtagatacacaaataatacaaatgaaacaatttaacttgaaagcttaaataaatattatcaagttaataaacaattaatttttagatggattcatcaaaaatcgtaaaaaagcacaatttgtattttacaaacattaattaaaaaagaaagcaagacattcgtgcaatcggttaccttaaattgtttacaactgtcaacaataccaaggttttattaactatatttctcacaaaattagcttttagcattccaaacaaaaaaggttaaatcgaacggaattatggcatttttaacttaattgtaaaaaaagttgataatggtcaattgttaatgaacagttaattataataacgcccaaaatatattattatttaattaagttaaataaaattatagaaagaaagtgaaacttatgcttaaaaataaaatattaactacaactttatctgtgagcttacttgcccctcttgccaatccgttattagaaaatgctaaagctgctaacgatactgaagacatcggtaaaggaagcgatatagaaattatcaaaaggacagaagataaaacaagtaataaatggggcgtgactcaaaatattcaatttgattttgtaaaggataaaaaatataacaaagatgctttgatattaaagatgcaaggattcattagctctagaacaacatattacaactataaaaaaactaatcatgttaaagctatgcgatggccattccaatataatattggtttaaaaacaaatgataaatatgtttctttaattaattatttacctaaaaataaaattgaatctacaaacgtgagtcagacattaggatacaatatcggtggtaatttccaatcagccccatcactcggtggtaatggatcatttaactattctaaatcgattagctatacac

SEQ ID NO: 6 - DNA, 1695 bp, Staphylococcus aureus
gatcatataaatagtgtttagatgctatagtcggatgcttaagtaatttaaagaaagtatctttaacatcgatgtgtgtataatcatttttagaagtattataatctttttcttctccttctaaaatatatacaggtgcttcatcagctagtggttcaactggaatgtcagcataaacttcgtcatcatatgttaaaacaaaacgatttgtatctgtaacttcacctataacagcactatccaattcgtgcttatcaaataaatctaagaatttttgttcagtacctttttcaacaactagtaacatacgttcttgagtttctgaaagcatcatttcataaggagaaatacctggctcacgtgttggcacttgttctaatctcaaatgtaacccactaccaccttttgccgccatttcagacgatgaagatgttaaaccagcagcacccatatcttgaataccaactaattcatcaaatgtaattgcttcaagtgttgcttccattaattttttacctacaaatggatcaccgatttgtacagaaggtcgtttactttcgctttcttccgtcaattcttcagatgcaaaagtagcaccatgaataccatctcgaccagttttcaaaccaacataaatgaccgaattacctacaccttttgctgtgcctttttgaatcatgtcgtgattgataacaccaacacacattgcattaacaagtggattgccatcataacgttcatcaaattcgatttcaccagcagttgttggaataccaatgcagttaccataacctccgataccctttacaacacctttaagtaatctttggttttgtttattatctaattctccaaatctaagactgtttaacaaattaataggtctagccccaatagagacaatgtcacgaatgattccaccaacgcctgtagcagccccttgatatggttcaattgctgatggatgattgtgagactctactttaaatactacggcttgattatcacctatatcgactacccctgcaccttcaccaggccccataagcacatggtcacctgacgtaggaaattgctttaaaaacggtttagaatgtttataagagcaatgttcactccacataacagaaaagatacctgtttctgtaaagttaggttgtctgcctaaaatatcgcaaactttttcatattcttgatcacttaatcccatatcttgatatactttttcaagtttaatttcttcaacgcttggttcgataaatttagacatgttgttccctccaactttttaccatcgcttcaaataatttcacaccactatcagtacctaacaacgtttctaaagctctttcaggatgtggcatcatgccacatacattgcctttttcgttaacaattcctgcaatatcatcatatgaaccgttcggattattcacatatttcagaataatttgattgttagcttttaattgttgatatatttcatcagtacaataataatgaccttcaccgtgagctacaggatatataactttttcaccttgttcataaagatttgtaaatgccgtttgattattcactatttctaactcttcatttctactaataaataaatgtgaatcgttatgcaataatgcaccaggtaataagcctatttcagttaaaatttgaaacccattacaaacacctaatact

SEQ ID NO: 7 - DNA, 1923 bp, Staphylococcus aureus
ttcaatttcttctaattccattctgtagccattcaatttgatttggaaatcaatacgaccttgaatgaaccattgaccattttcaaacttcgctttatcaccagtgtgatatgtacgaataccgtcatcgaaattaaatacttcagctgttttttggtcattttttaagtatcctaaacttacactttgaccttcgataacaagttcaccttcatctgtagtagataatcttgcgcctggtctttcaacgccaacaggtaatgtcggatattgatctaagatttcttgtgtaatttgaatacttgtaactgctaccgtagcttcagttggaccatatgtgttgtaaatcgtcgcacttgggaaacggtttactaacgcttttgctgctctgtgaggtagaatttcaccacagaagaagaattcgttaagactaccatattgttcttcattaagcgttggtaataataaacacatttccataaatgatggtgttgatacccaaatgttaatcggtgttgctgttagcatttcatttaataatttaggtttattaatcatgtttttatctacaagatttaatgtaccgcctgatgctaaacatggataaatagccattacagataaatcaaatgaaaatggcgcttggttaagccattgttgttcatttcctgatttattaagttctaacatccactcagtaaattgaactaaacttgcatattcaatttgaacacctttaggttccccagtagaaccagatgtaaagattgtgtatactgtgtcgttatctttaatctgactatcaaaaattactgggtcttgagatgttttaatatcttctattgtaaatacttcgccttctaaactttcaaatgattcatcagtcgtattaaatacaaactctggttgaaccttgttaataatcattttaatacggtcttcaggaattgaagtgtctacaggtacatatccacatcctgctttaatggcaccaatcatcccaacaatcatatatggtgacatgtgaccgaataaaatcatcggtttcttactaccttgtaatcgatgtgctaatttactagactcatccattaactgttgataagttaattcatcagttgtgtgtctaacagcaatgctttgtggatttgcatccgcaaacgcttgcagcttgttaataatatctgtcatattaagtctccctcattagaactcattataaatgaagttattgtgtgtgtcgccactgccataaattaaatataaagtaataaatattgccaaatacaatagtgttaataaatatggtttgaatgcttcaacatatttattaggtggctgtttacttttagatttcatattgcacctcttaaagttcttagtaaaaacgcctttataaagaccgttcaatataaaatacgttttaaaatttgttttttacaattcattatatcgatattcataatgaaattcaattttaattttatagattcaacatagtaattggttgtcatcactcaattattgtaaatgatacactttgttgagaacatcattcattttaaaggttatttaaacaataaacaattacagtctatataacaattttgttatatacgtcaaaatcaaataaactcatcacattaatatgacgagtttataatgttattgaattatcatcagcgcaaatatatacattcgcaagtcaagcataacatatttaacaattgctttgcttgttttaccaatgattaaaaaccatacttattttcaatttactggagtatgtggtacctgatttgtcataaccgcttctatattattaatacataattgaatcatattgtcccgtgttgttactgatgcgctaccaatgtgtggtgtaatcagaacattatcacgtcccattaatggatgtgtatg

SEQ ID NO: 8 - DNA, 1145 bp, Staphylococcus aureus
tgatccaaatattcaccaagctgtagttcaagatgataaccctgattttgaatctggcgaaatcactcaagaactacaaaaaggatacaagcttaaagatagagtattaagaccatcaatggtcaaagtaaaccaataacttaaatttggcgaaaagacattgtttaaaattaaattaatttaatgattaaatggaggaattttattatgagtaaaattattggtatagacttaggtacaacaaattcatgtgtaacagtattagaaggcgatgagccaaaagtaattcaaaaccctgaaggttcacgtacaacaccatctgttgtagctttcaaaaatggagaaactcaagttggtgaagtagcaaaacgtcaagctattacaaacccaaacactgttcaatctattaaacgtcatatgggtactgattataaagtagatattgaaggtaaatcatacacaccacaagaaatctcagctatgattttacaaaacttaaaaaatacagctgaaagctatttaggtgagaaagttgacaaagctgtaattacagtacctgcatactttaacgatgctgaacgtcaagcaactaaagatgctggtaaaattgctggtttagaagttgagcgtatcattaatgaaccaacagctgcagcattagcatatggtttagacaaaactgataaagatgaaaaagttcttgtttttgacttaggtggcggtacatttgacgtatctatcctagaattaggtgacggtgtattcgaagtactatcaacagccggtgacaacaaacttggcggtgatgattttgaccaagtaattattgactacctagttgcagaattcaaaaaagaaaatggcgtagacttatctcaagataaaatggcattacaacgtttgaaagatgctgctgaaaaagctaaaaaagacttatcaggtgtatcacaaactcaaatctcattaccatttatctcagctggtgaaaacggtccattacacttagaagtaaacttaactcgttctaaatttgaagaattatcagattcattaattagaagaacaatggaacctacacgccaagcaatgaaagacgctggcttaacaaactcagatatcgatgaagttatcttagttggtggatc

SEQ ID NO: 9 - DNA, 3880 bp, Staphylococcus aureus
gatcagaatacgattaagcaaggtgttaacttcactgatgccgacgaagcgaaacgtaatgcatatacaaatgcagtgacgcaagctgaacaaattttaaataaagcacaaggtccaaatacttcaaaagacggtgtcgaaactgcgttagaaaatgtacaacgtgctaaaaacgaattgaacggtaatcaaaatgttgcgaacgctaagacaactgcgaaaaatgcattgaataacctaacatcaattaataatgcacaaaaagaagcattgaaatcacaaattgaaggtgcgacaacagttgcaggtgtaaatcaagtgtctacaacggcatctgaattaaatacagcaatgagcaacttacaaaatggtattaatgatgaagcagctacaaaagcagcgcttaatggtactcaaaaccttgaaaaagctaaacaacacgcaaatacagcaattgacggtttaagccatttaacaaatgcacaaaaagaggcattaaaacaattggtacaacaatcgactactgttgcagaagcacaaggtaatgagcaaaaagcaaacaatgttgatgcagcaatggacaaattacgtcaaagtattgcagataatgcgacaacaaaacaaaaccaaaattatactgatgcaagtcagaataaaaaggatgcgtacaataatgctgtcacaactgcacaaggtattattgatcaaactacaagtccaactttagatccgactgttatcaatcaagctgctggacaagtaagcacaactaaaaatgcattaaatggtaatgaaaacctagaggcagcgaaacaacaagcgtcacaatcattaggttcattagataacttaaataatgcgcaaaaacaaacagttactgatcaaattaatggcgcgcatactgttgatgaagcaaatcaaattaagcaaaatgcgcaaaacttaaatacagcgatgggtaacttgaaacaagcgatagctgacaaagatgctacgaaagcgacagttaacttcactgatgcagatcaagcaaaacaacaagcatataacactgctgttacaaatgctgaaaatatcatttcaaaagctaatggcggcaatgcaacacaagctgaagttgaacaagcaatcaaacaagttaatgctgcaaaacaagcattaaatggtaatgccaacgttcaacatgcaaaagacgaagcaacagcattaattaatagctctaatgaccttaaccaagcacaaaaagacgcattaaaacaacaagttcaaaatgcaactactgtagctggtgtaaacaatgttaaacaaacagcacaagagttaaacaatgctatgacacaattaaaacaaggcattgcagataaagaacaaacaaaagctgatggtaactttgtcaatgcagatcctgataagcaaaatgcatataatcaagcagtagcgaaagctgaagcattaattagtgctacgcctgatgttgtcgttacacctagcgaaattactgcagcgttaaataaagttacgcaagctaaaaatgatttaaatggtaatacaaacttagcaacggcgaaacaaaatgttcaacatgctattgatcaattgccaaacttaaaccaagcgcaacgtgatgaatacagcaaacaaatcacgcaagcaacacttgtaccaaacgtcaatgctattcaacaagcggcgacaacgcttaatgacgcgatgacacaattgaaacaaggtattgcgaataaagcacaaattaaaggtagcgagaactatcacgatgctgatactgacaagcaaacagcatatgataatgcagtaacaaaagcagaagaattgttaaaacaaacaacaaatccaacaatggatccaaatacaattcaacaagcattaactaaagtgaatgacacaaatcaagcacttaacggtaatcaaaaattagctgatgccaaacaagatgctaagacaacacttggtacactagatcatttaaatgatgctcaaaaacaagcgctaacaactcaagttgaacaagcaccagatattgcaacagttaataatgttaagcaaaatgctcaaaatctgaataatgctatgactaacttaaacaatgcattacaagataaaactgagacattaaatagcattaactttactgatgcagatcaagctaagaaagatgcttatactaatgcggtttcacatgcagaaggtattttatctaaagcaaatggcagcaatgcaagtcaaactgaagtggaacaagcgatgcaacgtgtgaacgaagcgaaacaagcattgaatggtaatgacaatgtacaacgtgcaaaagatgcagcgaaacaagtgattacaaatgcaaatgatttaaatcaagcaatgacacaattgaaacaaggtattgcagataaagaccaaactaaagcaaatggtaactttgtcaatgctgatactgataagcaaaatgcttacaacaatgcggtagcacatgctgaacaaataattagtggtacaccaaatgcaaacgtggatccacaacaagtggctcaagcgttacaacaagtgaatcaagctaagggtgatttaaacggtaaccataacttacaagttgctaaagacaatgcaaatacagccattgatcagttaccaaacttaaatcaaccacaaaaaacagcattaaaagaccaagtgtcgcatgcagaacttgttacaggtgttaatgctattaagcaaaatgctgatgcgttaaataatgcaatgggtacattgaaacaacaaattcaagcgaacagtcaagtaccacagtcagttgactttacacaagcggatcaagacaaacaacaagcatataacaatgcggctaaccaagcgcaacaaatcgcaaatggcataccaacacctgtattgacgcctgatacagtaacacaagcagtgacaactatgaatcaagcgaaagatgcattaaacggtgatgaaaaattagcacaagcgaaacaagaagctttagcaaatcttgatacgttacgcgatttaaatcaaccacaacgtgatgcattacgtaaccaaatcaatcaagcacaagcgttagctacagttgaacaaactaaacaaaatgcacaaaatgtgaatacagcaatgagtaacttgaaacaaggtattgcaaacaaagatactgtcaaagcaagtgagaactatcatgatgctgatgccgataagcaaacagcatatacaaatgcagtgtctcaagcggaaggtattatcaatcaaacgacaaatccaacgcttaacccagatgaaataacacgtgcattaactcaagtgactgatgctaaaaatggcttaaacggtgaagctaaattggcaactgaaaagcaaaatgctaaagatgccgtaagtgggatgacgcatttaaacgatgctcaaaaacaagcattaaaaggtcaaatcgatcaatcgcctgaaattgctacagtgaaccaagttaaacaaacagcaacgagcctagatcaagcaatggatcaattatcacaagctattaatgataaagctcaaacattagcggacggtaattacttaaatgcagatcctgacaaacaaaatgcgtataaacaggcagtagcaaaagctgaagcattattgaataaacaaagtggtactaatgaagtacaagcacaagttgaaagcatcactaatgaagtgaacgcagcgaaacaagcattaaatggtaatgacaatttggcaaatgcaaaacaacaagcaaaacaacaattggcgaacttaacacacttaaatgatgcacaaaaacaatcatttgaaagtcaaattacacaagcgccacttgttacagatgtcactacgattaatcaaaaagcacaaacgttagatc

SEQ ID NO: 10 - DNA, 1741 bp, Staphylococcus aureus
gatcttttagtttatttatagttcttgaaaagcgtgctacaaatcctttaatcgattttaaattatttaaaaataaagcttacacaggtgcaacagcttcaaactttttgttaaatggtgttgcaggaacattaatagtagccaacacatttgttcaaagaggtttaggatattcttcattgcaagcaggaagtttatcaatcacttatttagtaatggtactaattatgattcgtgttggtgaaaagttacttcaaacactcggatgcaagaaaccaatgttaattggaacaggagttcttattgtcggagaatgtctcatttcattaactttcttgccagaaatattctatgtcatttgttgtattataggttatttattctttggtttaggactagggatatatgctacaccatcaacagatacagcaattgcaaatgcaccgttagaaaaagtaggcgttgctgcaggtatctataaaatggcttctgcattaggtggagcatttggcgtcgcattgagtggtgcagtatatgcaatcgtatcaaatatgacaaacatttatacaggtgcaatgattgcattatggttaaatgcaggtatgggaatattatcattcgttatcattttgttacttgtgcctaaacaaaacgacactcaattatgataattgagaattaaattgaaatcatacaagtcgctacaatattaaacaaaaatataaaccgattcttatgtgtcattattttaaatgaacatagggattggttttttattactcttttacgctactttatttataattattataaattgtcacaaattcaatttaccttacaatatattttgtgttattatattctggagcataaataaattgttcaacacatagttgtaatgtgtttcaatactttttggatagattgcgaaattgtattgaatcgtcatcgttttaaatttttaaatgagaatggaatgagcattacaatacacaagcaatcaaaagtaaatacattcacaacacaacagagacataacaacaagataaggagtgaacaatagctgtgaattatcgtgataaaattcaaaagtttagtattcgtaaatatacagttggtacattttcaactgtcattgcgacattggtatttttaggattcaatacatcacaagcacatgctgctgaaacaaatcaaccagcaagcgtggttaaacagaaacaacaaagtaataatgaacagactgagaatcgagaatctcaagtacaaaattctcaaaattcacaaaatggtcaatcattatctgctactcatgaaaatgagcaaccaaatattagtcaagctaatttagtagatcaaaaagtagcgcaatcatctactactaatgatgaacaaccagcatctcaaaatgtaaatacaaagaaagattcggcaacggctgcgacaacacaaccagataaagaacaaagtaagcataaacaaaacgaaagtcaatctgctaataaaaatggaaacgacaatagagcggctcatgtagaaaatcatgaagcaaatgtagtaacagcttcagattcatctgataatggtaacgtacaacatgaccgaaatgaattacaagcgttttttgatgcaaattatcatgattatcgctttattgaccgtgaaaatgcagattctggcacatttaactatgtaaaaggcatttttgataagattaatacgttattaggcagtaatgatc

SEQ ID NO: 11 - DNA, 2275 bp, Staphylococcus aureus
gatcaagaaaaacgtcaagcgtatgattcaaaagtgactaacgctgaaaatatcattagtggtacaccgaatgcgacattaacagtcaatgacgtaaatagtgcggcatcacaagtcaatgcggctaaaacagcattaaatggtgataacaacttacgtgtagcgaaagagcatgccaacaatacaattgacggcttagcacaattgaataatgcacaaaaagcaaaattaaaagaacaagttcaaagtgcaactacattagatggtgttcaaactgttaaaaatagttctcaaacgttgaatacagcgatgaaaggcttaagagatagtattgcgaatgaagcaacaattaaagcaggtcaaaactacactgacgcaagtccaaataatcgtaacgagtacgacagtgcagttactgcagcaaaagcaatcattaatcaaacatcgaacccaacgatggaaccaaatactattacgcaagtaacatcacaagtgacaactaaagaacaggcattaaatggtgcgcgaaacttagctcaagctaagacaactgcgaaaaacaacttgaataacttaacatcaattaacaatgcacaaaaagatgcgttaacgcgtagcattgatggtgcaacaacagtagctggtgtaaatcaagaaactgcaaaagcaacagaattaaataacgcaatgcatagtttacaaaatggtatcaatgatgagacacaaacaaaacaaactcagaaatacctagatgcagagccaagtaagaaatcagcttatgatcaagcagtaaatgcagcgaaagcaattttaacaaaagctagtggtcaaaatgtagacaaagcagcagttgaacaagcattgcaaaatgtgaacagtacgaagacggcgttgaacggtgatgcgaaattaaatgaagctaaagcagctgcgaaacaaacgttaggtacattaacacacattaataatgcacaacgtacagcgttagacaatgaaattacacaagcaacaaatgttgaaggtgttaatacagttaaagccaaagcgcaacaattagatggtgctatgggtcaattagaaacatcaattcgtgataaagacacgacgttacaaagtcaaaattatcaagatgctgatgatgctaaacgaactgcttattctcaagcagtaaatgcagcagcaactattttaaataaaacagctggcggtaatacacctaaagcagatgttgaaagagcaatgcaagctgttacacaagcaaatactgcattaaacggtattcaaaacttagatcgtgcgaaacaggctgctaacacagcgattacaaatgcttcggacttaaatacaaaacaaaaagaagcattaaaagcacaagtaacaagtgcaggacgtgtatctgcagcaaatggtgttgaacatactgcgactgaattaaatactgcgatgacagctttaaagcgtgccattgctgataaagctgagacaaaagctagtggtaactatgtcaatgctgatgcgaataaacgtcaagcatatgatgaaaaagttacagctgccgaaaatatcgttagtggtacaccaacaccaacgttaacaccagcagatgttacaaatgcagcaacgcaagtaacgaatgctaagacgcagttaaacggtaatcataatttagaagtagcgaaacaaaatgctaacactgcaattgatggtttaacttctttaaatggtccgcaaaaagcaaaacttaaagaacaagtgggtcaagcgacgacgttgccaaatgttcaaactgttcgtgataatgcacaaacattaaacactgcaatgaaaggtctacgagatagcattgcgaatgaagcaacgattaaagcaggtcaaaactacacagatgcaagtcaaaacaaacaaactgactacaacagtgcagtcactgcagcaaaagcaatcattggtcaaacaactagtccatcaatgaatgcgcaagaaattaatcaagcgaaagaccaagtgacagctaaacaacaagcgttaaacggtcaagaaaacttaagaactgcgcaaacaaatgcgaagcaacatttgaacggcttaagtgacttaactgacgctcaaaaagatgcagtgaaacgtcaaatcgaaggtgcaacgcatgttaatgaagtaacacaagcacaaaataatgcggatgcattaaatacagctatgacgaacttgaaaaatggtattcaagatcagaatacgattaagcaaggtgttaacttcactgatgccgacgaag

SEQ ID NO: 12 - DNA, 3327 bp, Staphylococcus aureus
tatcacaagctattaatgataaagctcaaacattagcggacggtaattacttaaatgcagatcctgacaaacaaaatgcgtataaacaggcagtagcaaaagctgaagcattattgaataaacaaagtggtactaatgaagtacaagcacaagttgaaagcatcactaatgaagtgaacgcagcgaaacaagcattaaatggtaatgacaatttggcaaatgcaaaacaacaagcaaaacaacaattggcgaacttaacacacttaaatgatgcacaaaaacaatcatttgaaagtcaaattacacaagcgccacttgttacagatgtcactacgattaatcaaaaagcacaaacgttagatcatgcgatggaattattaagaaatagtgttgcggataatcaaacgacattagcgtctgaagattatcatgatgcaactgcgcaaagacaaaatgactataaccaagctgtaacagctgctaataatataattaatcaaactacatcgcctacgatgaatccagatgatgttaatggtgcaacgacacaagtgaataatacgaaagttgcattagatggtgatgaaaaccttgcagcagctaaacaacaagcaaacaacagacttgatcaattagatcatttgaataatgcgcaaaagcaacagttacaatcacaaattacgcaatcatctgatattgctgcagttaatggtcacaaacaaacagcagaatctttaaatactgcgatgggtaacttaattaatgcgattgcagatcatcaagccgttgaacaacgtggtaacttcatcaatgctgatactgataaacaaactgcttataatacagcggtaaatgaagcagcagcaatgattaacaaacaaactggtcaaaatgcgaaccaaacagaagtagaacaagctattactaaagttcaaacaacacttcaagcgttaaatggagaccataatttacaagttgctaaaacaaatgcgacgcaagcaattgatgctttaacaagcttaaatgatcctcaaaaaacagcattaaaagaccaagttacagctgcaactttagtaactgcagttcatcaaattgaacaaaatgcgaatacgcttaaccaagcaatgcatggtttaagacagagcattcaagataacgcagcaactaaagcaaatagcaaatatatcaacgaagatcaaccagagcaacaaaactatgatcaagctgttcaagccgcaaataatattatcaatgaacaaactgcaacattagataataatgcgattaatcaagcagcgacaactgtgaatacaacgaaagcagcattacatggtgatgtgaagttacaaaatgataaagatcatgctaagcaaacggttagtcaattagcacatctaaacaatgcacaaaaacatatggaagatacgttaattgatagtgaaacaactagaacagcagttaagcaagatttgactgaagcacaagcattagatcaacttatggatgcattacaacaaagtattgctgacaaagatgcaacacgtgcgagcagtgcatatgtcaatgcagaaccgaataaaaaacaatcctatgatgaagcagttcaaaatgctgagtctatcattgcaggattaaataatccaactatcaataaaggtaatgtatcaagtgcgactcaagcagtaatatcatctaaaaatgcattagatggtgttgaacgattagctcaagataagcaaactgctggaaattctctaaatcatttagatcaattaacaccagctcaacaacaagcgctagaaaatcaaattaataatgcaacaactcgtgataaagtggctgaaatcattgcacaagcgcaagcattaaatgaagcgatgaaagcattaaaagaaagtattaaggatcaaccacaaactgaagcaagtagtaaatttattaacgaggatcaagcgcaaaaagatgcttatacgcaagcagtacaacacgcgaaagatttgattaacaaaacaactgatcctacattagctaaatcaatcattgatcaagcgacacaggcagtgacagatgctaaaaacaatttacatggtgatcaaaaactagctcaagataagcaacgtgcaacagaaacgttaaataacttgtctaacttgaatacaccacaacgtcaagcacttgaaaatcaaattaataatgcagcaactcgtggcgaagtagcacaaaaattaactgaagcacaagcacttaaccaagcaatggaagctttacgtaatagcattcaagatcaacagcaaacggaagcgggtagcaagtttatcaatgaagataaaccacaaaaagatgcttaccaagcagcagttcaaaatgcaaaagatttaattaatcaaactaacaatccaacgcttgataaagcacaagttgaacaattgacacaagctgttaaccaagctaaagataacctacacggtgatcaaaaacttgcagacgataaacaacatgcggttactgatttaaatcaattaaatggtttgaataatccgcaacgtcaagcacttgaaagccaaataaacaacgcagcaactcgtggcgaagtagcacaaaaattagctgaagcaaaagcgcttgatcaagcaatgcaagcattacgtaatagtattcaagatcaacaacaaacagaatctggtagcaagtttatcaatgaagataaaccgcaaaaagatgcttaccaagcagcagttcaaaatgcaaaagatttaattaaccaaacaggtaatccaacactcgacaaatcacaagtagaacaattgacacaagcagtaacaactgcaaaagataatctacatggtgatcaaaaacttgctcgtgatcaacaacaagcagtaacaactgtaaatgcattgccaaacttaaatcatgcacaacaacaagcattaactgatgctataaatgcagcgcctacaagaacagaggttgcacaacatgttcaaactgctactgaacttgatcacgcgatggaaacattgaaaaataaagttgatcaagtgaatacagataaggctcaaccaaattacactgaagcgtcaactgataaaaaagaagcagtagatcaagcgttacaagctgcagaaagcattacagatccaactaatggttcaaatgcgaataaagacgctgtagaccaagtattaactaagcttcaagaaaaagaaaatgagttaaatggtaatgagagagtcgctgaagctaaaacacaagcgaaacaaactattgaccaattaacacatttaaatgctgatcaaattgcaactgctaaacaaaacattgatc

SEQ ID NO: 13 - DNA, 2119 bp, Staphylococcus aureus
gatcgtgtattagcctcacatccagatgttgcgacaatacgtcaaaacgtgacagcagcgaatgccgctaaatcagcacttgatcaagcacgtaatggcttaacagtcgataaagcgcctttagaaaatgcgaaaaatcaactacaacatagtattgacacgcaaacaagtacaactggtatgacacaagactctataaatgcatacaatgcgaagttaacagctgcacgtaataagattcaacaaatcaatcaagtattagcaggttcaccgactgtagaacaaattaatacaaatacgtctacagcaaatcaagctaaatctgatttagatcatgcacgtcaagctttaacaccagataaagcgccgcttcaaactgcgaaaacgcaattagaacaaagcattaatcaaccaacggatacaacaggtatgacgaccgcttcgttaaatgcgtacaaccaaaaattacaagcagcgcgtcaaaagttaactgaaattaatcaagtgttgaatggcaacccaactgtccaaaatatcaatgataaagtgacagaggcaaaccaagctaaggatcaattaaatacagcacgtcaaggtttaacattagatagacagccagcgttaacaacattacatggtgcatctaacttaaaccaagcacaacaaaataatttcacgcaacaaattaatgctgctcaaaatcatgctgcgcttgaaacaattaagtctaacattacggctttaaatactgcgatgacgaaattaaaagacagtgttgcggataataatacaattaaatcagatcaaaattacactgacgcaacaccagctaataaacaagcgtatgataatgcagttaatgcggctaaaggtgtcattggagaaacgactaatccaacgatggatgttaacacagtgaaccaaaaagcagcatctgttaaatcgacgaaagatgctttagatggtcaacaaaacttacaacgtgcgaaaacagaagcaacaaatgcgattacgcatgcaagtgatttaaaccaagcacaaaagaatgcattaacacaacaagtgaatagtgcacaaaacgtgcaagcagtaaatgatattaaacaaacgactcaaagcttaaatactgctatgacaggtttaaaacgtggcgttgctaatcataaccaagtcgtacaaagtgataattatgtcaacgcagatactaataagaaaaatgattacaacaatgcatacaaccatgcgaatgacattattaatggtaatgcacaacatccagttataacaccaagtgatgttaacaatgctttatcaaatgtcacaagtaaagaacatgcattgaatggtgaagctaagttaaatgctgcgaaacaagaagcgaatactgcattaggtcatttaaacaatttaaataatgcacaacgtcaaaacttacaatcgcaaattaatggtgcgcatcaaattgatgcagttaatacaattaagcaaaatgcaacaaacttgaatagtgcaatgggtaacttaagacaagctgttgcagataaagatcaagtgaaacgtacagaagattatgcggatgcagatacagctaaacaaaatgcatataacagtgcagtttcaagtgccgaaacaatcattaatcaaacaacaaatccaacgatgtctgttgatgatgttaatcgtgcaacttcagctgttacttctaataaaaatgcattaaatggttatgaaaaattagcacaatctaaaacagatgctgcaagagcaattgatgcattaccacatttaaataatgcacaaaaagcagatgttaaatctaaaattaatgctgcatcaaatattgctggcgtaaatactgttaaacaacaaggtacagatttaaatacagcgatgggtaacttgcaaggtgcaatcaatgatgaacaaacgacgcttaatagtcaaaactatcaagatgcgacacctagtaagaaaacagcatacacaaatgcggtacaagctgcgaaagatattttaaataaatcaaatggtcaaaataaaacgaaagatcaagttactgaagcgatgaatcaagtgaattctgctaaaaataacttagatggtacgcgtttattagatc

SEQ ID NO: 14 - DNA, 1317 bp, Staphylococcus aureus
gatcgtcggctaaaacttgatgtgttacatctaaaccaaacacatttatagtaatcccactttcaaaaacacgcttcgctgcttcagcatctacccaaatattgaattctgctgtaggcgtccaatttccaaatgtaccaccacccatcaaagtaatagattcaatatgctcagcgattcttggctcacgaatcaatgccgttgctacattcgtaagaggacctgtcgctacaattgttacaggtgtatcactcgtcatcactttgtttataatcacatctgatgctggcattgcaactgcttgacgtgatggtgtcgacggtagtttcggaccatctaatccagattccccatgtatttcagaagcaaaggcagctggtttaattaacggcctatccgcacctttcgctactgctatatcttggcgtcccataatatccaatacgttcaaggcgtttgtcgtattcttgtcaactgattgattacctgcgactgttgttacagctaatatctctagtggactgtcaattgcccccgctaaaattaatgctattgcatcatcgtgtcctggatcacaatccataataatctttcttttcatttatatatccacctttcttaagttgttatcgatagcttatgtatatttatttatgtggtgaatcatgtttattttgaaaaatagttttaactttctcatatttttggatacaaacactatttatctattttatggcttataaatttatccgatatgccttatcaacctacctcgctaaaaataggatgtctacatatctataccgacttttgtcaactcattttcacaacaatataaacagcaatttatatgattgttacatgattcaaacaatttttatgaaaaatattttcatacacagaatatatattgatattaaatttctcaaaagctatattgagaataattaggagggatgttgatgaaatctttatttgaaaaagcacagcagttcggcaagtcctttatgttacctatcgcaatcttaccagctgcaggtctattgttgggtatcggtggtgcattaagtaatccaaacaccgttaaagcataccctattttagatattaccttattacaaaatatttttacattaatgtcagctgcaggtagtattgttttccaaaatttaccggtcatctttgcaattggtgtcgcaatcggattatctagaagcgataaaggtactgcaggtttagctgcgctgctcggtttcttaattatgaacgcaactatgaatggcttattaactatcacgggcacattggcaaaagatc

SEQ ID NO: 15 - DNA, 1317 bp, Staphylococcus aureus; identical to SEQ ID NO: 14

SEQ ID NO: 16 - DNA, 4350 bp, Staphylococcus aureus
atacacaacggctggtttatgtttagcatcgattgttttactgtcatcgtaaaatgcagctaacatcgcttcatcttcattgtcatgtaatgatttgtgcaaatgaattttttgcatcattaattgataatctttaggaataactttaacgacgacatcttcaatgcgatcaaaatgttttaacacatgaatcgctctcgtactattcgtgtgtgacacatgttcttccagcatttgcttaatgaatgctttttcttcttggtgtttaatctttgtaaacgaaagcgtatctagttgattattttcaacaaaagcttctacatcagacgggataacgtaagcaataccaccactcataccttgaccgaagttcttacctacatcacctaaattaatgacatgtccaccagtcatatactctaatccatggtcgccgataccttcaacgacaacatctacaccactatttctaatacagaatctttctcctgcactaccgttaataaatgccttaccacttgtcgcaccatagaatgagacgttaccagcaataatttcattttgtcgttcttcaaaaggtgctttgacaatgaccgtaccaccagataatcctttaccaacatagtcattcgcatctccagtatgatgaatcattaagcctttcggtgcatatgctgcaagactttgaccagcatgaccattcgtataaacattaattgtattttcaggaagtcctgcttctccatattgtttcgaaatctcactacctgtaataacccctacatcacgttgttcattatttactgtaaagctacctgtatagcgacgcccttcagcaatatatggcttcgttacttcatataaatttgttaaatcaaatccatgctcaagattatgattttgttgaatttcttttgtgtttggcccatcgaaaggacataacagtttttcaacatcaatactagccgctttgctattcgcttttaatgttgatgatcgttgtaataaatcagttcttccaactaagtcttctacacgtttcaaacctaaagatgctaaaatttctcttaattcttgtgcaataaaatgcataaaattaacaacatgatgtgctttacctctatataaagcacgtaaatctttgttttgagttgcaactcctactggacatgtatctttatggcatacacgcatcataatacagcccaacaccactaatggtgcagttgcaaatccaaattcttccgctccaagcgcacatgcgtacgctacatctttaccagttaataacttaccgtctgtttctaacttaacacgacttcttaagtcatttagttttaatgtttgatgtgtttctgctaaaccaatctcccaaggaacaccggcatgctgaatactcgttttgggtgaagcccctgtaccaccatcgtaaccactgatgacaattttatctgcaaatgcttttgccaccccagatgcaatggtaccaacacctgttttcgaaactaattttaccgcgatatctgcatctttattcgcatttttcaaatcatgtatcagttgcgctaaatcttctattgaataaatatcatgatgtggcggtggtgaaatcagaccgatacctggcgttgaccctcttgtcttcgcaatccacggatataccttagtaccaggtaattgaccaccttcaccaggctttgcaccttgcgcaactttaatttgaatttctttggcatgttgtaaataatcactagttacaccaaaacgcccagaagcaacttgtttaatcgcacttactttgttgcttccatcaacttgtacttcataacgttttgcatcttcgccaccttcaccactattactctttccacctaattggttcatggcttgtgctaacgtttcatgtgcttccgctgaaatcgatccataactcatcgcccctgtattaaagcgtttgacaatgtcacttaccggttcaacttggtcgatgtcaatcggtgtacatgctttaaattcaagtaaatgtctaatgtgatctgttctatttttgttcaccgcttcagagtatgctttaaattgcgcatagtcattttctttacatgcgtgctgcaataagaaaatagattccggattaaaagcatgatgttgaccttgttgtctccattggaatgtactacctgatgcaagataattatcatcactttgttgacgtgctttattttcagcatcaatttgatcaatcgaaataccagataacttagactgtgtcccagtaaaataacgatcaatcacatcatgagacaagccaatcgcttcaaatatttgtgccccttgataactttgcactgtcgaaattcccatcttagccattactttaatgacaccttctgacaatacatccgtatatgtcttaacattatcgacaacggtgccttgtaacccttctgtcaatgtcagttgttcaactgtacgttgcgctaggtatggcacaattgcattcgcgccatatgcgagtaaacaagcaacatgatgcacttctcgtgtctcaccagatttagcgactaaacttgtagacatacgtaaatctgctttaataagtaattgatgcacatgacttattgcgagtaacatcggcattgcaaagccattgctatcaactaatccactatcatctaacactagaatttgagcgccttgctttacagcattcactgcttctcggcctaatgcttctaacgcatcttccaaatccccttcatataccgttgataaataagttaatttaaaatgttcctgatcaatcgctgctaagtgtgattcattcaataccggccttttcaattgaatacgatctaaaaccgtttcgtcaggtgctagtaagttaccttcgccacctaaataagaaagttcactcgttacgattttttcacgatacgcatcaattggtggattcgtaacttgtgcaaacagctgtttaaagtaattaaatagtgattctggtcgctcgttcaacactgcaattggcgcatcatatcccattgcaccgataggatccttcttaccttctacaagttcctgaatatacttatgaatctcttctttcgtgtatgcaaactgacgttgtaatttaaataacgtctcatctttccattgcgaatcttgatattgtatattttcaaaatcaaagtcaactttatggttatcaatccacgctttatatggtaattctccagcaatcgcaccttttaaatcattattttcaatgactttattctgtttaaaatcaacaagcaataactttccaggattcaattgacctttaaaagcaacattactttcaggtacgtccacaacacccacttcagatgaaaagacaataaagttatctttagtaatcgtataacgacctggacgtaatccatttctatctgtaagcgcgccaagtttgtcaccgttacagaacgaaatcattgtaggaccatcccacggttccattaaataactataaaattcataaaacgcacgtacatttgcatcattcgcttcattatataaccaaggttcaggtatgagtaacatcgctgccttttctggctccatggctaacgataagaactctagcgcattatctacaatggcagagtcactaccatcctcatcgacaatttgaaacactttatgttgatcctcgccaaataatgtttcgattaatttatgttggcgtgctcgcatccagtttacattacctttaatcgtgttaatctcaccattatgcattaacatacggttaggatgtgcccttttccaactcgggaatgtattcgtactaaatctcgaatgcactaaccctagctttgattgatataaatcatccgataaatctgtatatagttttttaatttggtctgatcgtaaccaacctttatatacaattgttttgcgtgataagctcgtaaaatacaattctaaatcgcactgagtcgaatagaactctaattgttttctcgctaaaaacaaacgcttttcaacatcttcaatgtccctaatatcaataaacacttgttgaatgactggcatcgtatctgctacatgtttagcaatggcatctttattaactggtacattacgataaccaagaattgataacccttcgccttcaaaatattttttaaaaactacttcatgttcagaacctaaaatgcgttctttggaaaaaaataaccccacggcatattcaccttcacctgggatatcaaagtccgttacatgttgtttgaaaaatgcaaaaggtatttcagtcataatacctgcgccatcaccagtgatgccatctgcgccgaccccgcccct

SEQ ID NO: 17 - DNA, 1718 bp, Staphylococcus aureus
gatccattgttcgcagcagctgatgtcatttcatacataacttgtgaaataccatgaaaagacggattcgttatactttcacttgctccaggaatcataaaagcaagtgctgaaaatactaaaattaaaattgggtgtatgagaaagactaagacaatacatttcatttcacgggcgccaattggcatatttaaatattctggtgttttaccaaccatcaaactgcatataaacaccgtcagtaagacaaatatcaataaattcatgagtcctacgccttcgccaccaaatacaacatttagcatcattaataccattggtcctaatccacctataggcgttaagctatcatgcatgttattaacagaacccgttgtaaatgccgtcgtaataactgtaaatagtgctgacaaacctgctccaaaccgtacctctttaccttccatattcggtccataaatgcctaaattcgctagtattggattaccacgatactcactccacatagttaatgtaagaattgctataaaaatgaaaaacattgcgacaaataatatcaacgcatgacgatgtactcgtttaccatgtctacttaacatgcgaccaaataagaacaacattgacataggaagtaacatcatactgcccatttctataaaattgctccaaatatttggattttcaaaaggtgttgcagaatttcctgctaaaaatcctccaccattcgtaccaagatgttttattgattcaagtgatgcaataggtccaaatgcaatatgttgaatatgtccgcttaaagtccgaatcattaaattagcatgcaacgtttgtggtacaccttgagtcatcaataaaatactaattaaacatgataatggtaaaagtactcggacaataaaccgaacaatatcttgataaaaattaccaatgatattagttaatccagttaaacgtctcaacatcgctatacaaacggcgtaacctgatgcactagatgtaaacattaaatatgtcattacaatcatttgcgttaaatatgtcacatctgattcaccgttatagtgttgtaaattactatttgttaaaaaagatattgctgtattaaacgctaaatctatcgattggtttaaattatgatttggatttaaaaaaagccattgctgaactattagcaatacaaatgttataaaccccataaatccattaaatgccagaaaatgtttgacatatgttttagctgacatgtgttctaaatctgtgccgataattttaaaacacatattttcaaatctagtaaatattaaatctactcttgacgattgcaccaatgctacgcgatatagatatccactaaaaacatacgtaatcataaccatcattgttagaaacaaaattatttccatgataaccctcacttaatatatttctaaaatttttcactacgaattaaggcataaaataaatacaaaactaatgcaataactaccagtaataaaacgatgagcattgccataacctccttacaacacaacaacatcgtaacaacttgtttatgagagaaatattaattttcaaacttagttattaagaaatcattaagatgtgtatgcagaaataaattttatagcatttaattgtgaagaatattatgatattgctatcgaggtgaaggttatgtcaaacactgaatcgctaaacataggaaaaaagcgtggatc

SEQ ID NO: 18 - DNA, 2439 bp, Staphylococcus aureus
gatcactgcatctccatcattaacaccgtcattttgattctcaacgatgaatggtactacgaattcgtcagttaagccctcattatagcttgcttctacaccttctttggcagttgcataagttggggcatcaaaattacgaatagcattgtaagctttttcttcacgttcccaacgtttgtcacgatccattgcataataacgaccagacacagatgcaaattgaccaatgcctaattcattgaatttagcttcagtctcttcgatgtatttcaaagcggatttttgatctacgtcacggccatctaaaaatgcgtgtacgtaaactttttcaacaccttgttttttagcaagttctaacaaagcaaataaatgtttgtaatgactgtgtacaccaccgtcagacaataaaccaaagatgtgtaacgctgaatcatgtgaattcacgtgtgcaattgcattatttaaaacatcattttcaaagaaatcaccgtcttcaattgatttattgattcgagttaaactttgataaacgatacgtcctgcaccgatattcatatgaccaacttctgagttacccatttgtccttcaggtagtccaacatctaagccactcgcttcgatttgagtcgttggatatttgttgtaataacgatcaaaattaggcttgtttgctaattttaccgcattaccatgttcgctttcgcggttcgcaaaaccatctaaaataattaacgcagttggtttcttagccatgattattttgcaccttctaacaattgtacgaaatcttcaactttaagtgatgcgccacctactaatgccccatcaatatcagtttgtgccatgtattctttaatgttgttaggtttaacactaccaccatattgaatacgagttgcttctgatacttctttgcttgataagtcagcaatagtttgacgtacaaatgcacacatttcatttgcatcttcagatgttgatgatttaccagttccgattgcccagattggttcataagcaattacaactgatttaagttgatcttcagataaacctgcaacagctttcttaacttgctcacctacaacatcgttagctttaccactttcacgctcttcgtctgtttcaccaacacatataattggagtcattccatgtttgaaaatagcgtgcgcttttttgttaatttcttcatctgtttcgtggaataattcacgacgttcagaatgaccgataacaacgtatttaacgcctaaatctgctaatgcaactggagacgtttcacctgtgaacgcaccattatcttcgaaatacgtattttgagcaccgatttctaaaccttgtgcttttccttctttaactgcagtagttaatgcatctaattgaattgctggtgcacaaattactgattctacttcttttgaatctggtagtgttggtaatgtattgacgaagtcttttgcttcttgtactgttttgttcattttccagttaccagctataattggtgttctcattaaagacactccttgttttgtaaatatttttgaaaagtgatgaaacacgatgtcatcttgtgactgttttcccgtaacaatgttaaacaaacatgccacatcactttaaactatcactttattatttattattgattgctttgataccaggcaattctttaccttctaggtactctaatgacgcgccgccaccagttgaaatatgagtgaagtcattttcaaaacctaaagagattgctgctgcagctgaatcaccgccaccgataatcgtaattgcatctttaaggtttgcaattgctttacatacaccaattgtaccttgtgcaaagttactgaactcgaatacacccataggtccattccatacaacagtgtgcgcaccttctaattcatctgcaaataattttacagtgtttggtccaatatccataccttcttggtctgctggaattgaatcagatggtactacagtgattttggcatcattagaaaattctttagcaactttagtgtctactggtaatacaattttatcaccatgtttttctaataaatcttttgcgaagtcgattttatcttcttctaataatgaaataccaatttctttaccttgcgcttttaagaaagtataagccatacctccgccgatgataattttatcagctatgttaactaagtttttgatgacattaattttgtcagatacttttgctccacctaaaatagcaacaactggtttatgtggatcgttaactacgccgccaataaacttaatttctttatccattaagaatccagctgcagtttctaaatgtgtagaaataccaacattagatgcatgctcacgatgcgcagtaccaaaagcatcatttacaaacacatcacctaaagatgcccagtatttacctaattctggatc

SEQ ID NO: 19 - DNA, 1287 bp, Staphylococcus aureus
gatcctgaaacgtaattaattgaaactgtagaaccttcagtcaccttgttgtcttttctaatcactactactggtaaatttaaaatattagcaaccgcatttgccaatgaaataccttttgtcgcaatggtaacaacagcatctaatttttcttccatgtaaatactggcaattaacttaccaactttgtttagtagcgatggattacctaccaaatctgataaaaataaatatccgccaggtaacaaacgttctttctcttctaatagagtaatgacctcattaacaacttcagtcgcctcttctttactcatcattggtttatacgtaacaccaccacttgcgccagcagtagtaattactgtacctaacttttctttttggaatgtattttttataatttggacatcttcacttattgaagacttcgcctgtttaaattttttcacaaaaaaagttaatggaatcaatttattcggatggttcatcaaatattgcgtcataaaaacaattctctcgcttcgtttatatctcatcttttcaacccttctatcctaatagtctaactaagtacacttcattacaacaaccgttaactgcattataaatattttttgcttggctttcttttcgtgctagcccatacacagtaggtccgcttccactcattaacgcaccatctgcaccacttttcaacatattattttttaatttatcgatttgtgggtgttttgaaacagaaattggctctaatcgattagacaaactttgacataattgttgataatctcgattttctaaggcctcataacacattttcgtatgtacgtcgtaacgcttatctaaattaatcaacttaaatatatctggtgatgatatgcctaagtttggtttagcaagaatcacccaagctgaaggtggtttatttaaaaactcgattttctctcctcttccagtacatagtgcagttttattataaatacaaaacggaatatctgtcccgattttactgcctagtagagccaattcttccaaactcgcccctatatcaaaaagtcgattcaatcctcttaacgttgctgctgcatcagccgaacctccagctaagccagcagaaacaggtatttctttatcgatagaaattgttacaccttgctttagttgatattgctcaataaatagttgcgctgcacgatatgcgagatttttatgattagaaggcacataattatgttcaatctcaacaactatctttcgatcttttcttttatgaaaagttaaacgatc

SEQ ID NO: 20 - DNA, 1909 bp, Staphylococcus aureus
gatcgacaacactctaaatatatagaaaataggtattaatttaactataaatctaaataataatgcaaagatgattaaaataacgatagctaaagcaataccaataataaaatctttggtcgctagctcacctatcatccccatatagaaaatgataacctcgacaccttcacgcaacacagatattaaaccaatcgtcgctaacaataccaaattaccattactaatcgcattagcatacatatttttaatcatgtcattccaacgttttgcatttgaacgtttgtgcatccaaacaccaacgataaacattaatatgaccgcaacgatacctaatcccgcttccatactttcacgaagaatgccactattccctaaagtttctacaaacgtaattgctaagataatactcagtacaagtccggcaattgcaccaccaatcacacttgcagtccctttcttatcttttacattacgcgtcatggtagtcaatgtcattacaattaacaacacttctagcccttcacgtaaaaagataatcatcacatcgacgaagctataactatggccaacaacctctttaatttggttatttaaatctactaaaccatctttcacatgtgctttattatgttcgtctaatacactttgataatatggtattttatcttcaattttcgtatacaaagcaccgtctttagtttgaatttgaccttcaacatacggccaagtttctataaaatgtgtaagcgcagcatcagcatccgacaattgattgtcgtcgatagctttaatcgccttctctaacgcatcatttaattgtgatacatggtattgatcatttgcagacgtattactttttttatcgacatgatcaatatttgatttaaaagttgtccaagcatgtgacacttttgccgtatctaatggtgacttatgaattgcaattctaagttgtaataatgcgacttcaatttgtccatattgatttgcgtcataattgcgaatcactgtttcattacttgtccaaatctgattcaaactattgttcaaagattctaattccgctttatttttatctttaatcgcttttgtcatcgcagcatctttagcatcgacttgctgttgcaatagtttaattttagaacccgcatctttactagccaatttctcttcataagcaattaatgacttcgttaattgcgaaagtgtatctttttgattatcattcgcttttgcatcttcaagctttctcacatctgatttgacagcattactttcactattatcttcaagcgataatttcttaactgcacttaccacttgctcaattgctttctgcttattgtcattcgatatcgaattattagaaagtgcagatttcgcatccgttatcacactatatacatcactaatactttgttgttctgctgcctgacttttcagtaacccaaagctacacaccatagcagcagttattagcattgctacaaatttagtcaaataatgtttcaccaaggtatcctcccttactaacacctggtaatactaaaaatgaagcagaacctctatgtgtaatatattcatttaatttatcattactacctaaattattttgtatatcgataaattgttttgtcgctttttgaaaagcaataaaaagtaagcctgtttcgaagttacctgtgcggtcatccgtaccatccacataattaaaggctctacgtaaaattgacgtatttgcttctttcgctagcctcgtatgggcatctttatcaataatatactcgccatgactatctttcgcttttaagtcaatttcatcaaactctttcccacctgttaacggtgcaccactatgtcgtttccgaccaaatgtagcctcttgttcttccagcgcagtacgatc

SEQ ID NO: 21 - DNA, 1384 bp, Staphylococcus aureus
gatcgtttaaatgttcaatatattccgctgcactttgcgctgcaatactaccatcgccagtagcagtgacaatttggcgtaaacctttgtcgcgaacatctcctgctgcaaaaatacctggtactgatgttgtcatatcatcttttgttacaatataaccaacatcatttgtaatacctaagtctttaaatggcgctgttaatggtttcataccaatatagatgaatacaccatcagcctcgtgtgtttcttctgaaccatcttttgtagacgttaatgtcacagaacccactttgccgtctttttcattaattgatttcaaagtatgactccaaataaagtcgattttatcatttttgaatgctctatcttgtaaaatacgctgtgcacgtaactcatcacgacggtgaacgattgttactttgtcagcaaatttagttaagaatgttccctcttctactgctgaatcaccaccaccgataacgaataggcgtttatttttaaagaatgcaccatcacatactgcacaataacttacaccgcgtccaccaagttcttgttcacccggaacaccaattttcttgtattctgcacctgtagcaataataaccgctttcgctgttaattctttattaccaaagttaatcactttatattcgcctttatcttctacagatttaatatctccatattgataaactgcaccaaactttttagcgtgttcaaacatttttgtagataaatctggacctgtaatcatttcgaaaccagggaagttctctacttcttctgtattagccatttgaccgcctggaatacctctttcaatcataactgtttttaaattagcacgtgatgcgtatactgcagcagtcataccagctggacctgcaccgataattgctatatcaaaatctatttcagtcattttattaacgcctcctcattattaatcattatgcgcattatataataaatctaacttttcataaatctatatgctcaagagaaattcaatcattttgttcagtttatattgtgttatgcctaaccatgttgtaatttgcttctttgtaacgtttcgaggttgatttttaaaatacaaataaataaacgcaccgatatatggctcaacatcagttaaatctactttttcagcaattatgagttcaccttgattaatccatgcaaccattacatcattttcacttacaaataattcattatggtaaagcgttaataagccgcgatgaatgaagtctaatttattgagcgttaaaccttgaactaaatacgttaaatacaatttctcataattatttagattttccaaaacctgccaaatactttccgtcatcacaatttctttaccatttaattgatc

SEQ ID NO: 22 - DNA, 3089 bp, Staphylococcus aureus
gatcgttgatttgattagtgatggttgaacaaattaaaaataaactacttactgcaaatactacgcccataacgataaacgtagtagctggtgtagtataacttgtaatggcagcgccactaagactgccaataatttgaccaacaactaacatactgttcgtcgttccaacaaatgtgcctttaagttgttgatgacacgcattcacgacaacaaacatgacactttgaatcaatgcactatatgttaatccttgaagtattcttgcagccattaaaaactctatattcgtcgctaaaccttgcagtatcgcactacaaccacatgcaatcgtggcaaatatatatactgatttaacatatgatttatcattaaagcgtccccataaaggcgcgcttaatatcgaagccgtccaaaatgcggactgtaaaaatccaatcacactacggtcatctatcgctgtatgattcactgatgaagcaagtggtgataatgcagttagcatgccatacatagcaaagtttgctaaaacgccaacgataataaatcgacatgtttgttgtgtgcataatagacattgaaatgaacggcgaatacctttattaatatttggtgtttgtgattttggcatatgtgtcgtttcaatcaattttaatgcaccgaaaatacagacaataaaagtaataacggcaatactcatcagtaacgcactaaaacctaatatcgaagctgtaacaccgccaattaatggccccacaagagaccctgcgctgactgaactttgcagtcttcctaatacctttccacgatcttcagctggcgcctctgcactcgcaaacgcacttgatgcatcaacaacaccaccaaatagtccctgcaataacctcacaagtacaaactgtaatggtgtcgtacacaatgccattaaaaataagcataccgccaaaccaagtaacgctcttaacaccatccattttcggctgatcttatcacctagcttcccccatatcggcgaagctatcatcgtcgttacagctggagcagcaatcgctataccactccacaactgtatttctacgactgatagattttgtagtgatgccatataaattggcaataatggcacaagtactgtcagtccagcaatcgctataaactgactgagccataaaatgcgaaagttactgcgccatatagactgattaatcatatgtcaccattggatttggtacggtagttaaacctgaaggcatactacctccaccactatcacgttgatatagcaatggtaataaaatttgtttgaatggccacgtctgtttatcaaataaaatgtgtctgacagctagctgatcagttgtaacccaggaaatagttgccacttcattttttaaaatttgttttaacaacgacataagttcatgctcacttacaccaaataaatcttgaattgcatcaataatggcatatagatttaccgatacagctaatgtttgaaaataagcaaagaatgtttccaaatcctcattaattagcgtattaggtgtatcttctctgacgacatacttcggcaatgaaagctgatgtgctgttagccatggtttataaattctgacagtatcatgatcacgtaacacgcatttttgtacacgtccatcttcaaatgacaacaatatattttgaccatgcaactctggtaatgcgccgtattgcataaatgatagtgttacctttaaaaagacttgcgcgatatcttcaaataacgtcatgacatcatttttagaaatattatcttttccacaaatcatttgatataaagtgcgatcatttgccgcgagtgctgccattgacactagctgttgcgtatcatttttggctagcacttcgggatactttcttagctgaacagttagatgacctaattgatctttgaaaatatcattatcttgacccatatatgaccaccaagctgtttcatcacaaaccatgacatacttagctagtgcttcatctttttctataagctgacgtaataattgttctgcttgttctccgtttttcatgtaacgcgtaggcgttagccttaatgcgcctaatgactgcattgcaaatggtactttgacatggttatacggtgcgccaatatcaattaatgaacgcatacttgaagacgacagataatctccaaattttaacggtaatagtacaaccaacttttcactaatctctttcgcaaagacgttcggcagaatatgctgatattgccaaggatgtaccggaaatagtacatagtcatctattgataacccttgatcatttaacatgtctgtcgcttgttcttttataggtactgtcaaattttctaattcatcgatatttgcagtatcgccatgaatcatatgtgtctttttaactgctgcaaccattaaaggaaatgattgatttaattcagcttgatacacttgataatccgcttctcttaatcctcttttttctttagctaatggatgaaatggacgatcttttaaacttgcaaactgctctgacatcacaaaaggatgtgacgctaaatctaattctgataattgtttagcaagctgtgtggcagcagtagtcagtccttcttcaacgcgagccacttcccattcatgacttagatcacaattcatattagcaattgtttgccaaaattcagctgccgttaaaggttgcttagacacccttccctctatcgtaattggttgtgaactttcgtaacgaaacatatttaaagcactaaaataaacaggtatctttatttgttgtgtttcacgttcgtatatcaaaagcgtttgtccgttttctttagtaatctcactattcgatacaattccggctatatcttcaaataataatgcatcaactaaatctcttaatattatcgcttgtgctgtattgactgctgtatgattctgcaatgttcagacacctcgcattcttaatataggttcaatgttgtcccaatattttgttgttgtgcctgttgataaataaaataagcacttgaaatatcttcgatagccatacccatcggattaagtaatatgatc

SEQ ID NO: 23 - DNA, 11365 bp, Staphylococcus aureus
gatcgcttacaaaacataacaagctttaaagatattgccaaaattctttattcaacgagagcaggcgttgcttatatggctacaggtggtatggctggcgctttacgtgccacattagattatgtcactgagcgtaagcaattcggcaaaccaattagtaaatatcagttaatacaagaaaagctagcaatgatgcaaggtaatttagctcaagcaatggcaacatgtgctcaattagctaatatgcaagcacatggtgaatatgacgaggttgcaacttcaacggcgaagatgatgaatgccttacgtttgcgtgagacagtagctatgggccgcggtattacaggtggtaatggcatactagctgacgattatgatattgcacgtttcttctctgatgcagaagcgatttacacgtacgaaggtacacatgaaattaatgccttagtaattggacgcgctttgactggagattctgctttcgtataaatagcaaataattatatgagatgcattaatttcactaaaaaagacttattttaagcataaagctttttccttaaataagaggctaagatgactgtcaaagatacttaattaattttataaaatagcaacgttattccaattatcttaatggttatcttatcctcaactaaattggaggaatcactatgacaattaataaagtaaccgttcttggcgcaggcacaatgggcgctcaactggcagcactttttgtgaatgctggacttaaagtaaaactattagatattgtagtggacaaaaacgatccaaatctcattgcgaaaaaatcttacgataaaattacagataagaaacggccgctactattcgacttaaatctagcgagtcatttaacatatggtaattttgatgatgacttggtaaatgatgatgctgatttatatatcgaagcagtcaaagaagatattgaaattaagcatgctgtttggcaacaagttctacaacatgctaaagaagatgctttattcgctacaaatacatcaggtattccaattaatgcgattgctcaagcatttaacgagaaggatcaagaacgattctttggtctacatttctttaacccaccacgtattatgaaattagtggagttaatacctacgtcacacacgaaggaatctattatattagatgtaaaaaatttcgcgcaaaatgtgttaggtaaaggtgtcattgtcgtcaatgatgtgcctggctttgtcgcaaatagagtcggcacgcaaacaatgaatgatattatgtatcgcgccgagcaacacaagataagcattgtagatgtggatgctttaactgggcaagcgattggtcgtcctaaaacaggtacatatgcgctatctgacctagtcggtttagatattgcagtgtctgtaattaaaggcatgcaacaagtacctgaagaaacaccttattttcatgatgtcaaaattgtaaatacgttgtttgacaatggcgcactcggacgtaaaacgaaacaaggattttacaaaaaggataaagaaactaaagctcgacttgtttacgatgttgaaaaacaagattatgtacctgtatcgcaaccacaattaccaattttaaatgaatttaataaagacttagtgcataaccttgataccatattcaatgcgcaagacgaagcgggactatttttatgggagacattacgtaataatttctattactctgctatcaatgtacctaaagctaccgatgatttccgagacatagaccgtgcgcttgtctgggggttcaactggaaacttggtccattccaattatgggatgcaatgggatacgaacgtgttaaaacacgtatggaagacgaacttggagacttaccacaatggattagtgatttagatggtggcttttataaacaagatgagaccattgaatatgcaacacctatttctcacttcgtaaaagatgaactttgggataaaggtgatgccaaactttccgtaactcatgatgatcaactgttactgaaattacaaagtaaaaataatgtcattaccgatgaattcaacgatgcgttagttgatgcgattgatttactggaaaatgaccattacacaagtatggttatttatgcagatggtaacaatttcagtgtgggtgctaaccttttcttaatgaaaaaggcgcatgaagacggtcttgtagatgatgtcgttgcacaatcaattgataaattacattatagctttaatcgtttgaagtatagtttgaaaccagtagtcacagctgttcaaggtcgtgccttaggcggtggctgtgagcttgtactttactcacctattgttgtcgctgcaagtgaaacatatatcggtcttgttgaagcaggtgttggcttattaccgagtggcggtggccttgcagaaatggctgatcgcatattacgcacatcgcataagtttgatgacaaacaagcttccatgacaaaagtactgacgaatatcgcatttgcgaaagtctctacaaatgcctttgaggcacgtcgttatggttatttacgtgatacagatacgattattttcaatacagcacaacgtgtcgaagttgcgctcaaacgtgcgaaatatgaagcagaaacaaactatattccgaatcctagacatcaatatatcgctttaggtgaagacttcaaagcattgatccaaggacaattagatgcgcaaagacggggtcattttattagcgaccatgattatcatattgccttaaatatcgccacaattttagcgggtggtgatttaccaagaaatacatttatcaatcaacgttacattcaatcgttggagaaaattggctttattgacttactaaaatctaaaaaatcatatgaaagaattgcacatatgttaaaaactggtaagccattacgtaattaaaagatagtcattaagagaggatgataaccatgcaagaagcatacattgtagcttatgggcgttcagccgcagcgaaagcaaagcaaggcgcattattccacgaaagacctgatgatgtcgcagccaaagtattacaaggcgtattgaaacgtattgacggaaaattcaataagaatatgattgaagatgtcattgttggtacggcttttccagaaggattacaaggccaaaacattgcacgaacgattgcattgcgtgcgggattatctgacacggtaccgggtcaaacagtgaatcgctactgctcatcaggattacaaaccatcgcgattgcagccaatcaaattatggctggtcaaggagatatacttgtagctggtggcgttgaattgatgagtgccgtaccaatgggtggcaacgagcccacaaacaatccaaccttacaatatgatgatataggtgcgtcatatcctatgggtttaactgctgaaaatgtagcatcccaatttgacgtatcacgcgaagatcaagatgcttatgctgtcagaagtcatcaacgtgcctatgacgcacaacgtgatggtcggttcaaagatgaaattattccaatacaagtaaactcagttgaatatacaaacgcaggaccaaaagtacacacaaatatctttgaccaagatgaatttatacgccctgacaccacgatggaggcattagccaaattacgtacagtatttaaagctgacggcactatgactgcaggaacatctgccccactttctgatggtgcaggatttgtagttttaatgtctggagataaagtgaaagaactcggcgtgacacctattgcacgattcgttggttttaaggcagtaggcgttgacccgaaaattatgggtattgggcctgcatatgcgattcctgaagtattgtcactcagcaatctatctgttgaagacattgatttgatcgaattgaacgaagcatttgcttctcaaacgattgcatctattaaagaagtaggtctagatatatcacgtacgaatgtgaatggtggcgctattgctttaggtcatccattaggtgctacaggcgcaatgttaaccgcgcgtttacttaatgaaatgggtagacgtcccgatagccgttacggcatggttacgatgtgtattggtgtcggcatgggtgcagctgctatatttgaatatgtgcgttagaatggttgattttggatgaagcggattcgttttgttattgaatgaagtaggctgaagttgaagccagttgaagttgaagcgggttgaagcaatttcgttttattaatgaagctgtgtgaaatatagtgattgaacaaaaaaagtggtttaatgggatggtggttatttccgttttagaatttaacatttacacgtctaattttaatcattgttttaaattttatgaatcgaagccctttgatttaataatatttgctaatgctagtaacttatctgattgttcatgtttaaaataaagaaaaccactcacatcagtgtgtgttcgaactagacttgtaagttccagttcggcacgactttctaaagcaattattattgctgtgattgtcgtatatcacttagatgtgcgtggtttattttaataggttagtaatatattaggtcatgttatgtttaagactataatgaataaataatttagaaatatgcttccgattgttcgatgctttaattcagttagaagcatcatagaatgcatgattactgttgtaaagatacgtaatgttttgtattgactgtatgtctttggatagagttacaaacttattttgttactctaggcccatatgtcgcagtaccatctgcatgtgttgttacattgtatgcatttgttttacttggcttcttgtatgtcgggcgagctccgtatgacacttgaccgtttgcatgtgttgttacgttgtatgcatttgttttgcttggcttgttttgtgttgggcgagcgccatatgatacttggccgtttccatgtgttgttacgttatatgcgtttgttttgcttggcttgttttgtgtcggacgagctccgtatgatacttggccgtttgcatgtgttgttacattgtatgcattcgtttcgcttggcttcttgtatgtcggacgagctccgtatgatacttgaccatttgcatgtgttgttacgttatatgcatttgtttctgatggcttattgaatcttggtctcgcttcatatccaaatgttccatcgttgtattcacggatacctgtaccagcatctctatatttaacatatttaggtgttttgttaaattgcggtctcggaccatattgagaagcttctgttgtttcagttgcttgaggtttaacttcaatatcacttgattctccttgagtaccttttaacgttgattcagtaccttgtggttttatttcaagtttagatgagctaccttcaagaccttctaaaatagggttcgttaacggtgggtttgtataattattgcttaatgatgggccgctttgttccattgttagaaaatcgggaccttgaacgatttcaccttgtaccgttttattttccatcgttggatattccggaccttttacaatttcacctgtaattgtgccctgtggaattttaactaatggttgtgcaactggttgtgttgtttcttcagctttaccagccgtagttttaacctcttgttggttatcaactttaggtgcttgaggttcttcaactttcttctcttcttttactactggcgattttgtttcagtttctccgtattttttgacagttttctttttccaagaatcatctgcttctttaactgcttttttcgtttcttcaactaatttatcaaaattaggtttattatcactatttgttttatagttatgtgttgtaggattatatttcgttatagatttcggtctattttgtttagtttccataaagaaatcatcaataattgaatttaagtcatcaatcatttcttttttaatacgttcatttgtaattttatgtggattgtctgtatctccaaggattaagtccagttttgctcgtaactctttcgcgtgctccccataatccttatcaccataatatgatacaactaatgtatcaatttcagatacgagatcgtatacttccttagttgctttatcttcttctgctgcattaaaagttttcaagtctgaattcttatccttaatatctttaacttctctgtgaaaatcatccagtgctctctttaatgcatcctgtagttcattgtattctttcatcgaaagttcttctaaattatatttatgaaaattagccatttttaaatctgtacgaggattttcttttttataatttgcataccattgtttataatcttcatattgagatttctttctctccaaaagatattgatcttcccttaataccttttccaacaacctatctttagcttctttataaatattatctccatattcatatttattagttaatcctatagcataaattatatagtcttccaaataatatagagctgaatttaaatatctgctatctattaatgtcccatttttactcccagcattaacttgtgatttcccactataatcctttgttactatcgcatctgctttgttatcccatgtaaataagctagatgcaactgctaatgcgcctagcgaaattatttgctttttcataattttttaattcctccaaaatgtaattgcccaatctacattaaagaaacaaaatattaaaagacattaactatatattaactagaataaacaaagcattaactatctttttgttatagttaattagctttgcaatatacaatagtgtataatttttttgattaatgtacatcaaaggagtaacaaagcatgacaacacaaatgaaaatcaaaacatatttagttgctggtattaaagcggcgctccttgatacgactggtattaaattagcaagcaaatctgaaactacatcacatacgtatcaacatcaagcgcttgtagatcaattacatgaattaatagcaaacactgacttaaataaattatcgtacctaaatttagatgcgtttcaaaaacgcgatattttagctgcgcactatattgcaaaatccgctatacgcactaaaaatttggatcaaatgactaaagcgaaacaaagattagaaagtatttacaattcaatttctaaccctttgcattcacaaaacaattaataattcaccaataaatcatgtaagtgtttgtgacgccaaattgccatacaaatacttgtcatatgaatataaacgaatgaaacgattgcctatcccatagatggcaacattaaaaagacctctgaaggtatcatcttgataactttagaggtctttgtttatattattcaaacaaaattcttatagaacgatcgaagtatgtttcgtctttcttttcttctttaatctgatcagctaatgctgggtcatctgtgataataccatcaacattggtttgtaagtatttcgttaaatcttcttcgccgttaatagtccaagtatagacttctttattttccaagtgcgcttgattaacaagtcttggcgaataagaaaaatcttcgatgacaaagaaatctaatgatgtttctttaaaatgaccaaactgcaacggaatgatataaccacacttgagatatggcgcttcttttttcaacttagtcatcacatcataatccaaagacatcacacgatattgatgttcaacaccatgctttttcaaaatatcaataacacgttgtgtataatctgctggttctttaccatgtggctttaactctactagtagcttcacatttgattgtttagccgtttcaataaattcgtctaaggatacaaattttgcttcatgtccattttgacgcattttcaaaccgacgatatctttgaaattagattcagaaatatttttattaacacctgttaaacgtttcaaattgttatcatgactaacaacaaattgtttatctttcgtcataattgtatctaactcaacgtattcgacattcgcttttgcagcagctttcaatgacggaatagaattttcaacacctttatcttcgaaaccacgatggccaataatggagatatttgtattgatagtattattgtaaagtaagtacatgttataaccgataaaacatgtcactgcaagcaccattgaaattataaagaacctagacttccgtttcggttttggatatttaaattctaagcccggttggtctaatacattctcttgttttaagtgcagtactaacacactgattaatgataatttcgtaaataaataatagaagaacaatgcgcttttcaatacaacaaataaaattgatgagactaaaaacttatctccttcttcatctacacaaatagcaagatatgttgctcctgaaataattaatgttaaaatcgcaccaatgatgagttctaatataactatttctataacaagccgaaacttatttcgcttcgtaatttgccaacttagtctcatatttttaaataacgactggcggtttaaaatcgttaacggtagagtaaatattaatttaaaatttaatataaatacagcaatcataaaggtaccgtaaatgattatacctttcgtcgttttcataagttcttccgttaaaaatttaggtatgtaaatattttttgttaatactgaacttagtcctaggttggcaatgggtatcattaacattaaataaatgacaaagaaaataactggtacacctatgagtttacgcacatttacaaaggcatttttaaaaatggatttaaatgtaataatctgtcgatcaaagccggcataaaccatataaactaacaatgaaaactctacataaatcagaaaggcaacacttaatatgaatataataagaagtatcacactggcgggatgactaacgatttccgtccaattgttaatcgtaagttggctttgcccagctacttttaacatcatattaaatagtaaaattaagtatgtactactaataaaaatcatgattaactgcaatagtaaggcattaatgctaaaacgccctttattttgatacagtaatttaaatactgcccatatatctttactaattctcttcataatcacgctccgcattgctttaatattaagtttcatcttaatatttttcattactcagggtcaataaaaatttgaaaagactcatattcatatgcaagtagcaaataataacccattcaacatcagctaaatgatgatattggaaccccacctttaacaagacatcacattctttatcagcatagctacttacaaaaacgtcttccttcaaccattgtagaagttgtctcatatacttactacgtcttgctaatactcaatactcaattgaaaaagaagcatatgccccttcactcttgaagttgcatatgctttcttttcggtctgaattgtatttataattcaacgggaattttccctttgaagttaacataacggtaggctgctttaacagcttcatcatcgggcgcttcgacatcttctaattcatatgcaatgcccaatgttttccacttatgaacacctaactgatgatatggcagaatttcaaacttttcgacgttatcaagagaattaataaattcccctagtttaattaaatcgtctttatcatcagaataaccaggcacaaggacatgtcgaatccatacaggttgtttcatatctgacagtttgcgcgcgaagttaaggatgtgtgtattaggctttcctgtcaatctaatatgtttgtcattatcaatatgttttatatctaataatatcaagtctgtatgtttttgtaattcttcaaaatgcctttgaaatgcttttgtatcattagcacatccagccgatgtgtctaagcaagtgtgcacaccattttcttttaattctgcaaataatttttctaagaatggcatttgtaacaatggttcgccaccactgactgttacaccgccacccgatgcatcaaagtatggtttgtatggtaatatttcattcaccatttcatcaactgtgacttctcttgatggctcactaattttccaagtatctggattgtggcaatacaagcatctaagtaagcatccttgtgtaaataatatatatcttaatcccggtccatcgacagtacctaaactttcgacagaatgtaagtgtcccttaagcatagtgctcccaccttaaattttgttacatactttcatggaatgtacgagaaattacatctaattgttgttcacgtgttaatttaatgaagttaacagcgtaaccagatacacggattgttaactgtggatattcttctggatgttccattgcatctattaatgtttcacggttaaatacgttaatatttaagtggtgaccacattgcattgcgtaaccatctaacatactagttaagttacggttttgatcttctggttctttacctaatgattttggtacgatactgaatgtatttgaaataccatctttacagcaatcgtaagggatcttagctacagaacttaatgaagataatgcacctttttggtcacggccatgcattgggtttgcacctggagcaaatggttcgccagctttacgtccgtctggtgtgttaccagttttcttaccgtatacaacgtttgaagtaattgttaatacactcattgtatgttctgaatcacgatatgttttatgactacgtaatttagtcatgaagcgttctactaaatcaactgcaatatcatctacacggtcgtcattgttaccgtatttagggaagtcgccttcgatttcaaagtctactacaagaccttcttcgttacgaattggtttaacttgtgcatatttaattgcagataatgagtcagctgctactgataaaccagcgatacctgttgccattgtacgtacaatttctgtatcatgtaatgccatttcaatacgttcatagctgtatttatcgtgcatgtagtgaataacatttaatgagttaatgtaaacacctgctagccaatccatcatttgatcaaatttcttgaatacttcgtcatattctaatacttcgctgttaataccttcgaagtttggaccaacttgtgcaccagatttttcatctttaccaccattgatagcgtaaagtaatgttttagctaagttcgcacgtgcaccgaagaattgcatttgtttaccaattgtcatcgctgatacacaacatgcgataccatagtcatcgccatagctttcacgcataatgtcatcattttcatattggatagaacttgttttaatactcatttttgcacagtatgttttgaagttgtcaggta

SEQ ID NO: 24 - DNA, 1688 bp, Staphylococcus aureus
ctgaataaaaacgcaacaaatagtgcaaatgctatccctgtgatagcgaataaaatattcatgtatcatcacctacaataatttattaacagcgacagcaattttagcacccaacgccgcattgttttcaacaagttttatatttgctgctaaacttttaccattcgttttttctacaattttccctaacaagaacggtgtggcgtccttacctttaataccttgattttccgcttcaacaacagcttcatttatgattgcctcaatatatgcttttgataaggcatgctcatatggaattggattagcaacaacaatgccaccttcaagatttaactgctgttttgttaaatgaatgtcagcaagtcgttctggcgtttcaaccgaacttgttaacttaacaccgctttcgcgagtgaagaatgctggcaattcattcgtttgatatccaataactggaacgccttttgtttctaaatactccatcgtcttaggtaagtctaaaattgatttggcacctgcacagataacagtgacatttgttttagacagttcttctaagtctgctgaaatgtccatcgtatgttctgcacctttatggacgcccccaatacctcctgtaacaaaaaattgaataccagccattgcagcacatatcatcgtcgtcgctacagtagtagcaccaacacacttcatcgcaataacttctgctaaatcccttctagatactttagcaacgtctttactagttgccagtatttctaaatcttcgctttctaaaccaattttaattttgccatctataatggctatggttgctggaatggcaccattattcctgataatttgctctactgttgttgccatttcaacattttgtgggtacggcataccatgcgaaataattgttgattctaatgctacaatcggttgattgttctcccgtgcttgctgaacttctcgagaatactcaatatacttttgtaaatttgccatttttataatcctccatatcgtgataaagttgctgttgatctaggttttgcctaactgtatatttcgtttctatcgttttctttgcgttaaccataccagcaattaatatatcttcagtagacatcccatttaaccagctatacactactgcagcacagaatgaatcgcctgcacctgtaacatctttcacactatttgatggcataactgacttaatgatttcttcctcaccacttcgataaatgagttctttcacgccatttgtcacaataacatttttaacacctaaatcattccagcgtttagcagctatttttaaatcatcagtagattctatttttaaatttaagtatgtttctgtttcatctttattcgtgataatccaatcaatagcatgtaatgaatcaggcatatttttcatttttggggaagaaaccgtggtgataactaatttgatttgatgtttcgtggtataggcacataagaagtttaatgcctctttgcctaaattcaaatctacaataatgcacttagcctttttcaataagtgtgaacgcttaattaaaaattcaggcgtaatgtagtcaaacacttccatatctgctaagccatatgtcatgtcgccttctttactaattaaagctgtatatgaacctgtactcgcattttcaaattgttgaacatgatccaaa

SEQ ID NO: 25 - DNA, 2131 bp, Staphylococcus aureus
gatccattggccttttaccaattgaaacatcgccagacaaaacactttcaatacctaaaccacttaacaaacctgccaataatcgtgttgtcgtaccagaattacctgtatacaatacttgatgtggcgtgttaaaagattgatatcctggggaagtcacaactaatttttcatcatcttctttgatttctacacctaacagtcggaaaatgtccatcgtacgacgacaatcttcgccaagtagtggcttatatatagtagatacaccttcagctagcgacgccaacatgattgcacggtgtgtcattgacttatcgcccggcacttctatttcgccctttaacggacctgaaatatcaatgatttgttcatttaccatttcattcacctacttaaaatatgtttttaattgttcacatgcatgttgtaatgttagttgatcaacatgttgtacaacgatatctccaaattgtctaatcaagaccatttgtacaccttgcttatcattctttttatcacttagcatatattggtataacgtttcaaaatccaagtcagttatcatgtctaaaggatagccgagttgtattaaatattgaatataatgattaatatcatgcttagaatcaaacaaagcattcgcaactataaattgatagataatgccaaccatcactgcatgaccatgaggtattttatgatagtattcaacagcatgaccaaatgtatgacctaaatttaaaaatttacgtacaccttgttctttttcatctgcaataacaatatccagcttcgtttcaatacctttagcaatatatttatccataccatttaatgactgtaatatctctctatctttaaagtgctgttcgatatcttgcgtcgctgattcaccattcaataacgcatgcttataaacttctgcatagccacttaatatttgctcaaatggtaacgtctttaaaaagactaaatcataaatcacagcagttggacgataaaatgcaccgataaggtttttaccttgctttgagttaatacccactttaccgccaacactagaatcatgcgctagtatagtcgttggcacttgtataaagtgcacgcctcgtaaaagtgtcgccgcaataaacccagcaaaatcaccagttgcaccaccaccaacagcaataattgctgtattacgagttacatgatgggataaaatatactctaatgtttcttgatattgctcaaatgttttcgtcttttcaccagctggaataataactttatgtacattttcatatgataaaatatcatcaaatttatcagcaaaatattgatttacatgctcgtcaattaatataaaactttgatcaaactgatcaatatacgtgctaatatggtcaattgcaccgtgttcaacatatattggataattatttgaagggtatgttgtttgtaatttcatgattacacctcaattgttcttgttgttaaaactcaatatttaattgtctgcgctcaataatttgttgtttaagttgctcaatatgatttgattggaattcttccaataatgcttttgctatttcaaatgctacgacatgttcgcagacgatacttgctgcaggaacagcacaactatcagaacgttcaattgttgctttaaagtcttctttagtattaatgtctactgaatttaatggtttatataacgttggaattggtttcattacaccattaacgataattggcattccatttgacataccgccttctaaaccacctaagtgattagatccacgataataaccaatttcactattatatagaatttcatcttgaatctcactacctggcttttcagctgctttaaatccttcaccaaagcttacacctttaaaagcatttatgctgacaacaccttgtgcaatcttaccatctaacttacgatcataatgcacataactacctacaccaacaggcatattttcaactacaacttgaacgacaccgccaattgaatctccttcatttttagcttcgtcaattttatctcgcattgcttgtgcgatactgtcatcaattacacgaacatcattacgatcaagatttgctttaaatgtttctgaatcataaaaatctt

SEQ ID NO: 26 - DNA, 1612 bp, Staphylococcus aureus
gatcgaccaattcaagtgggctcacattttcatttttatgaagcaaatgcagcattagatttcgaacgtgaaatggcatatggaaaacatttagatattccagctggagcagctgttcgatttgaacctggggataaaaaagaagttcaattagttgaatatgctggcaaacgtaaaatttttggttttcgtggtatggtcaatggtcctatcgatgagtcacgtgtctatcgcccaactgatgaaaatgatgaatatgcaggtgtattcggagataacggtgctgaaaacgtgaataaaaaaggaggaaaaagatcatgagctttaaaatgacgcaaaatcaatatacgagcttatacggtccaactgttggagattccattcgtttaggtgatacgaatctatttgctcaaatagaaaaagactatgcggtttatggtgaagaagctacttttggtggtggtaaatctattagagacggtatggcgcaaaatcctcgtgtaacacgtgatgacgtgaacgttgcagaccttgtcatttctaatgccgttattatcgattacgataaagtggttaaagctgatataggcattaaaaatggttatattttcgccataggtaatgccggcaacccagatataatggataatgtcgacattattataggttcaacaacagatatcattgccgctgaaggtaaaatcgtcactgctggtggtattgatactcatgttcattttattaatcctgaacaagcagaggtcgcattagaaagtggtattacgactcatattggtggtggtactggtgcttcagaaggttctaaagcaacaactgtaactccaggtccatggcatattcatagaatgttagaagctgccgaaggtttaccgattaatgtcggttttacaggtaaaggacaagcaacaaatccaactgcactcattgaacaaatcaatgccggagcaattggattaaaagtacatgaagactggggtgcaacaccatctgctttgagtcatgcattagatgttgctgatgaatttgatgttcaaattgcattacatgcagatactttaaatgaagcaggatttatggaagacacaatggctgctgttaaagaccgtgtacttcatatgtaccatactgaaggtgctggtggcggtcatgcgcctgatttaattaaatccgctgcattttcaaatattttaccttcatctacaaatccaactttgccttatacacataatactgtagatgaacatttagatatggtaatgattactcaccatttaaatgcggctattcctgaagatatcgcattcgcagattcacgtattcgtaaagaaacgattgcagcagaagatgttctgcaagatatgggtgtattcagtatgattagttccgattcacaagcaatgggccgtgtaggtgaagtaattacacgaacatggcaagtagcacatcgcatgaaagaacaacgtggtcctttagatggtgattttgaacataatgataataatcgcatcaaacgttatatcgctaaatatacaattaacccagcaattacacatggtatttctgaatatgtaggatctatcgagccgggcaa

SEQ ID NO: 27 - DNA, 6421 bp, Staphylococcus aureus
  misc_feature (1587)..(1596): n is uncertain
  misc_feature (5604)..(5613): n is uncertain
gatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaaggatatattcggaacatcttcttcagaagatgcggaataacgtgacatattgtattcagttttgaatgtttatttaacattcaaatattttttggttaaagtgatattgcttatgcgagcgcttgacaatctattctttttaaagaaagcggttgttagacaatgcattaagaaaaattaaagcggagtttacttttgtaaatgagcatttgattttttgaaaataaagcagtatgcgagcgcttgactaaaaagaaattgtacattgaaaactagataagtaagtaaaatatagattttaccaagcaaaaccgagtgaataaagagttttaaataagcttgaattcataagaaataatcgctagtgttcgaaagaacactcacaagattaataacgcgtttaaatctttttataaaagaaaacgtttagcagacaatgagttaaattattttaaagcagagtttacttatgtaaatgagcatttaaaataatgaaaacgaagccgtatgtgagcgtttgacttataaaaatggtggaaacatagattaagttattaagggcgcacggtggatgccttggcactagaagccgatgaaggacgttactaacgacgatatgctttggggagctgtaagtaagctttgatccagagatttccgaatggggaaacccagcatgagttatgtcatgttatcgatatgtgaatacatagcatatcagaaggcacacccggagaactgaaacatcttagtacccggaggaagagaaagaaaattcgattcccttagtagcggcgagcgaaacgggaagagcccaaaccaacaagcttgcttgttggggttgtaggacactctatacggagttacaaaggacgacattagacgaatcatctggaaagatgaatcaaagaaggtaataatcctgtagtcgaaaatgttgtctctcttgagtggatcctgagtacgacggagcacgtgaaattccgtcggaatctgggaggaccatctcctaaggctaaatactttctagtgaccgatagtgaaccaccaccgggagggaaaggggaaaagccccccgggaggggagggaaataaaacctgaaaccgggtgcttacaagtagtcaaaacccctttatgggtgatggcgcgccttttgtaaaaagaacccgggagctaccatttgatggcagggtaaacaatacatgtggagccctaccgaaaggcaccctgaatagggggtttattatttgggccgcgacccccaaacccgttgtgctccccttgggcccgctgtgactttttgccactcctctgtgtgggagcgtccccccgtcacccccgggccgcccggcgcagccccgccgggcgccccgaccaccccataactagctgannnnnnnnnntcagctagttatttgttttagccttgctggcctgcaggtcggactctaaagcaccccaaagctacccggggaaacaggcttatctcccccaaaattcacatcgacggggaggtttggcacctcgatgtcggctcatcgcatcctggggctgtagtcggtcccaagggttgggctgttcgcccattaaagcgggacgcgagctgggttcaaaacgtggtgagacagttcggtccctatccgtcgtgggcgtaggaaatttgagaggagctgtccttagtacgagaggaccgggatggacatacctctggtgtaccagttgtcgtgccaacggcatagctgggtagctatgtgtggacgggataagtgctgaaagcatctaagcatgaagcccccctcaagatgagatttcccaacttcggttataagatccctcaaagatgatgaggttaataggttcgaggtggaagcatggtgacatgtggagctgacgaatactaatcgatcgaagacttaatcaaaataaatgttttgcgaagcaaaatcacttttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcagttttaaatcggagaattagctcagctgggagagcatctgccttacaagcagagggtcggcggttcgaacccgtcattctccaccatttattcttacatattgccggcctagctcaattggtagagcaactgacttgtaatcagtaggttgggggttcaagtcctctggccggcaccatggaagagccattagctcagttggtagagcatctgacttttaatcagagggtcagaggttcgaatcctctatggctcaccatttgcgggtgtggcggaattggcagacgcactagacttaggatctagcgccttacggcgtgggggttcgactcccttcacccgcatatgcagaagtagttcagcggtagaatacaaccttgccaaggttggggtcgcgggttcgaatcccgtcttctgctccatttttatagtgccggggtggcggaactggcagacgcacaggacttaaaatcctgcggtgagtgatcaccgtaccggttcgattccggtcctcggcaccattttcaataaaaacatatgcgcccgtagctcaattggatagagcgtttgactacggatcaagaggttatgggttcgactcctatcgggcgcgttaattatacgggaagtagctcagcttggtagagcacttggtttgggaccaaggggtcgcaggttcgaatcctgtcttcccgatatactgtaattattatgggggcttagctcagctgggagagcgcctgctttgcacgcaggaggtcagcggttcgatcccgctagtctccaccatattatttacaaactatataaggcggtgtagctcagctggctagagcgtacggttcatacccgtgaggtcgggggttcgatcccctccaccgccactatttattagttgtaaaattatatttaggacctttagctcagttggttagagctaacggctcataaccgttcggtcgcaggttcgagtcctgcaaggtccatataattttggaggaatacccaagtccggctgaagggatcggtcttgaaaaccgacaggggcttaacggctcgcgggggttcgaatccctcttcctccgttttactaatggtctcgtagtgtagcggttaacacgcctgcctgtcacgcaggagatcgcgggttcgattcccgtcgagaccgccatttaattttataattaatagcgatttacctataataatggaggaatacccaagtccggctgaagggatcggtcttgaaaaccgacagggccttaacgggccgcgggggttcgaatccctcttcctccgccattattttttattatcgcgggatggagcagttcggtagctcgtcgggctcataacccgaaggtcggtggttcaaatccgcctcccgcaatattttataggtctcgtagtgtagcggttaacacgcctgcctgtcacgcaggagatcgcgggttcgattcccgtcgagaccgccatcattacatttttattatggttcagtagctcagttggtagagcaatggattgaagctccatgtgtcggcagttcgactctgtcctgaaccatttcttagccggcctagctcaattggtagagcaactgacttgtaatcagtaggttgggggttcaagtcctctggccggcaccatttatggaggggtagcgaagtggctaaacgcggcggactgtaaatccgctccttcgggttcggcagttcgaatctgcccccctccatttattatttttaataggggcatagttcaacggtagaatagaggtctccaaaacctttggtgtgggttcgattcctactgcccctgccatggcggctgtggtgaagtggttaacacatcggattgtggttccgacattcgagggttcgatccccttcagccgcccttattattaatgggctatagccaagcggtaaggcaacggactttgactccgtcactcgttggttcgaatccagctagcccagttattggcggcatagccaagtggtaaggcagaggtctgcaaaacctttatcaccggttcaaatccggttgccgcctccaggtttatgcgggagtagttcaacttttagaacacgttccttcccggaacgaggtataggtgcaaatcctatcttccgctccataatttaataataatgcgggagtatttcaactcttagaatacattccttcctggaatgaggtataggtgtaaatcctatcttccgctccataatttaatatttgcgggagtagttcaacttttagaacacgttccttcccggaacgaggtataggtgtaaatcctatcttccgctccataattgcttccaaagggaagttttttgtttaccattaagccggtgtggcggaattggcagacgcgcgggactcaaaatcccgttccacttgtggagtgtcggttcgaccccgaccaccggtataattaactgttatttacataacataacgtattagaaaccttgtaaaacaaggtttctttttatttctctctatacaatacaaataaaagtggactcaaatggcacacgctttaatagactctatgtcaaattgtaatgatgagttcaatattggaagttaagcaactatgcattgtttaacggttctccaccaaatgtggtgggtatataatttaaagaactatttttaaaatacaacttttagagtttttattattaggcggccagtccattattgggcttggttgtcttctttttttctcctttgtacaagctgaaaatcatcattatacgtgctttaaagttgttgaaatttctgtaaccaaaagaaattcacttgattaattttatcttattattaattccttctatagcaccattattaaatgctgggtaataaattgtatttcttaacatcctttgatgttttctataatatttaaccactttccatacacccttactcacagactttttactaactgaatttaaacgattaataaatttaggccaattacataaccttaggtcttttcgtaatccttggacaagttcgtaggagtgtcgtagtatatcgtcttttgaaagcatgaattctacaatgtcagatgagcgtttataagccttaaaagatttattccatctgtatttactaaagatggttttactagtatccatcaataggactttccagttattcttaaaaattgaataatcaggtccttttttattacggtattcattcataacttggacacgatacttattaaggtcctctatttaaatgttgaacgatatggaatccgctaactagctgannnnnnnnnntcagctagttactctccccaataatcatccttgagggagccctaaagctatttggagagacccagcatctcaggttcgattggatttctccctcccctcagttcatccgctcacttttcaacgtaagtcggttcggtcccccattcagtgttacctgaacttcaacctgcccaagggtagatcccctggtttcgggtgtacgaccaaataataaacgccctattcagactcgctttcgttacggctccacatttactgcttaaccttgcatcaaatcgtaactcgccggttcattctacaaaaggcacgccatcacccattaacgggctctgactacttgtaagcacacggtttcaggttctatttcactccccttccggggtgcttttcacctttccctcacggtactggttcactatcggtcactagagagtatttagccttaggagatggtcctcccagattccgacggaatttcacgtgctccgtcgtactcaggatccactcaagagagacaacattttcgactacaggattattaccttctttgattcatctttccagatgattcgtctaatgtcgtcctttgtaactccgtatagagtgtcctacaaccccaacaagcaagcttgttggtttgggctcttcccgtttcgctcgccgctactaagggaatcgaattttctttctcttcctccgggtactaagatgtttcagttctccgggtgtgccttctgatatgctatgtattcacatatcgataacatgacataactcatgctgggtttccccattcggaaatctctgg

SEQ ID NO: 28 - DNA, 2038 bp, Staphylococcus aureus
gatcgctagtacttcttcaggtgatgaagcatgtaataatttctcacgtacattttcatccattaaaataccagacaacttagctaaagcatctagatgtgtttgggcgccaccttctggcgctgcaatcataaagaataagtgtgctggttgcatatccaaactttgataatctacgcctgctttagatttaccaaacgcaatagctggtgacttaactgcggccactttggcatgtggaatggcaataccttcgccgataccagttgtactttgtgattctcgattgtgaatcgcttccttaaatgacgcgacatcacttaatttacctgctttgtctaattgatttactaactcatcaataacaccatttttgtcatttgccattaaatccattgctattgtatcttttgttaataactctgttactctcattattttcactccccatcaagtacgctaatcgtaacttgtgattttattttttctatagcgtcccgtgttgctaagtcctcatcaaatgccgtggcagtaccgcatgcgactgcttgttggaatgctttttcaatcgttaaacctgaagcaattccagccaccatgcctgcaactgtactatcaccagagccaactgtattaaccactttcccttgtggattaactgctttaatactgatttctttatcaatataaatagcaccatcaccgccaagcgagacaataacagattgcgcacctttatcaactaacaaacgaccatatttaataacatctgtgtctgagttcactgttgtattaaacatcacttctaattcatctttattaggtttaataaatagtggatgatatggtaaaacgctttcagccaattctttttcagcgtcgactactaatttagcacctgtctgtgctgtaatttgtgcaatttgcgcatacgcatcgcttggaatactacttggtacacttccagcaacaataactatatcttcgcttgttgtatttttaatttgttgtaacagttgttcaaattgtgttgacgttatatgaggacccggtgcattgatttctgtttcttgtcctgtttttaatttcacattaatacgtgtatcttcatcaacttcaataaaattcgattgaattgcactgttatttaatgtatctataatgaatttcccaggaaatccacctgcaaatcccaaggcagttgactcaacatccaatgtctttaagacgcgcgagacattaatacctttccccccagcgaatttatatgttgctgttgctctgttcaaaccatcaattttaaaatcattcgtaaaaatgacatagtcaattgaaggattgaaagtcactgtataaatcataaagtccctcctataaagtgatacttttgttggtattcttttaacgattcttgatttaatgctttttcagatgtgatgattgtcgtactttctagcaaaggtacacgagcaaaatatactttattaaacttagaatgatctataagtacaaatgattgattggctaatgacattgctgtttgtttaactaatgcctcttgctcatcgggagtagttaatccaagttcaatatctaatccattcatcccgataaaagctttatcgaaacaatatcgtcttaatatctccatagcactagaaccaatcgtagcaagtgtattttctttaacttgaccacctagcataattgttttaataccttttttaagtaaagcttctacatgtgttaaaccattggttaccacaatgatatctttcgcttgaatatatttaattagctccaatgtagatgaaccagcatcgataaataagcattcattatcgttgatttgattagctgctattttagcaatcattttcttttcatcaagattcgttgctaatttttcagttaaattcgcctcaaccatacgattttcttttaacattgcaccaccatgcacacgttgcaatttccctaattgttgtagtttagataaatctcttcgtattgttgaagcactgcaaccagttcgatc

SEQ ID NO: 29 - DNA, 420 bp, Staphylococcus aureus
ggatctcctgtattgaattctaaacatgaactgattggtattttatatgcaggtagtggaaaagatgaatctgaaaagaatttcggtgtttatttcacaccacaattaaaagaatttattcaaaataatattgaaaaataagtatcatcaattcattcgtgaagttgattttttaaagagtgattaagaaaacggttacataattaactaaatatactgaattatgtatctagatatcaaaataattaaaagagaggaacttaaaatgaacaaaaacgtagtcatcaagagtttagcagcattaacaattttaacatctgtaacaggtattggaacaacattggttgaggaagtacaacaaactgccaaagcagaaaataatgtcacaaaagttaaagatactaatatttttccatatac

SEQ ID NO: 30 - DNA, 2806 bp, Staphylococcus aureus
gaaaaataagtatcatcaattcattcgtgaagttgattttttaaagagtgattaagaaaacggttacataattaactaaatatactgaattatgtatctagatatcaaaataattaaaagagaggaacttaaaatgaacaaaaacgtagtcatcaagagtttagcagcattaacaattttaacatctgtaacaggtattggaacaacattggttgaggaagtacaacaaactgccaaagcagaaaataatgtcacaaaagttaaagatactaatatttttccatatactggtgtagttgcttttaaaagtgcaactggatttgtagttggaaagaatactattttaacaaataaacatgtgtcgaaaaattacaaagtgggcgatcgtattactgcacatccaaatagtgataaaggtaatggtggtatttattcgattaaaaagattattaattatccaggtaaagaagatgtatcagtcattcaagttgaagagcgtgcaatagaacgtggaccaaaaggctttaattttaatgataatgtaacgccattcaaatatgcggcaggggctaaagctggtgagcgaattaaagtgattggttatccacacccatacaaaaataaatatgttttatatgagtcaactggccctgtgatgtcagtagaaggtagcagtattgtatattcagcgcatactgaaagcggaaactctggatcacctgtattaaacagcaacaacgaattagttggtattcattttgcttctgatgtaaaaaatgatgataacagaaatgcatatggcgtctactttacaccagaaattaaaaaattcattgcagaaaacatagataaataaacaaattgactttaaacgagcgttgcaacatatctcgaattgtaaaggagcttgaaaatgaataaaaatatagtcattaaaagcatggcagcattagccattctaacctcagtaactggaataaatgctgcagtcgttgaagagacacaacaaatagcaaatgcagagaagaatgttacgcaagttaaagatacaaatatttttccatataatggcgtcgtttcatttaaagatgcgacaggttttgtaattggaaaaaatacaattatcaccaataaacatgtatcaaaagattataaagttggcgatagaattactgcccatccaaacggtgacaaaggaaatggtggtatatataaaattaaaagcatttctgattatccgggtgatgaagacatctctgtcatgaatattgaagaacaagcagtcgaacgtggaccaaaaggctttaattttaatgaaaatgtccaagcattcaattttgcgaaagatgctaaagttgatgacaaaattaaagttattggttacccattacctgctcaaaatagttttaaacagtttgaatctacaggaactataaaaagaatcaaagacaatattttaaattttgatgcatacattgaacccgggaattcaggatcaccagttctaaattctaacaatgaggtcataggtgtggtgtatggcggtattggaaaaattggttctgaatataatggtgccgtatactttacgcctcaaatcaaagattttattcaaaagcacattgaacaataaacaaatttaaatatacaccatgagcatgtgttcaataattttaatgaaaaacatcggtcgaatataacataaaaaaacgtctatatcaaaagcatcatgaataaacagaggagcacaaaaatgaataaaaatataatcatcaaaagtattgcggcattgacgattttaacatcaataactggtgtcggcacaacagtggttgatggtattcaacaaacagccaaagcagaaaatagtgtgaaattaattaccaacacgaatgttgcaccatacagtggtgttacatggatgggcgctggaacaggatttgtagttgggaatcatacaatcattaccaataaacatgttacttatcacatgaaagtcggtgatgaaatcaaagcacatcctaatggtttttataataacggtggtggactttataaagttactaagattgtagattatcctggtaaagaagatattgcggtcgtacaagttgaagaaaaatcaacgcaaccaaaaggtagaaaattcaaagatttcactagcaaatttaatatagcatcagaagctaaagaaaatgaacctatatcagtcattggttatccaaatcctaatggaaataaactacaaatgtatgaatcaactggtaaagtactatcagtgaatggaaatatagtgacatctgatgcggttgtccaacctggcagctctggttcacctatattaaatagtaagcgagaagcaattggtgttatgtatgctagtgataaaccaacaggtgaaagtacaaggtcatttgctgtttatttctctcctgaaattaagaaatttattgcagataatttagataaataaatcatccatccatacattgataaatgatttttagaaattaacaacaaaatcaacaattttaaacatctctgtgattctatttattcgaaatgatttaaaaaataaaacttcaaaaacctaaccttatatttatacgaatacttagaggagcacaaaaatgaataaaaatataatcatcaaaagtattgcagcattgacgattttaacatcagtgactggcgtcggcacaacagtggttgagggtattcaacaaacggctaaagctgaacataatgtgaaactaatcaaaaatactaatgtagcaccatacaatggtgtcgtttcgataggatc

SEQ ID NO: 31 - DNA, 3343 bp, Staphylococcus aureus
ggatcaccagttctaaattctaacaatgaggtcataggtgtggtgtatggcggtattggaaaaattggttctgaatataatggtgccgtatactttacgcctcaaatcaaagattttattcaaaagcacattgaacaataaacaaatttaaatatacaccatgagcatgtgttcaataattttaatgaaaaacatcggtcgaatataacataaaaaaacgtctatatcaaaagcatcatgaataaacagaggagcacaaaaatgaataaaaatataatcatcaaaagtattgcggcattgacgattttaacatcaataactggtgtcggcacaacagtggttgatggtattcaacaaacagccaaagcagaaaatagtgtgaaattaattaccaacacgaatgttgcaccatacagtggtgttacatggatgggcgctggaacaggatttgtagttgggaatcatacaatcattaccaataaacatgttacttatcacatgaaagtcggtgatgaaatcaaagcacatcctaatggtttttataataacggtggtggactttataaagttactaagattgtagattatcctggtaaagaagatattgcggtcgtacaagttgaagaaaaatcaacgcaaccaaaaggtagaaaattcaaagatttcactagcaaatttaatatagcatcagaagctaaagaaaatgaacctatatcagtcattggttatccaaatcctaatggaaataaactacaaatgtatgaatcaactggtaaagtactatcagtgaatggaaatatagtgacatctgatgcggttgtccaacctggcagctctggttcacctatattaaatagtaagcgagaagcaattggtgttatgtatgctagtgataaaccaacaggtgaaagtacaaggtcatttgctgtttatttctctcctgaaattaagaaatttattgcagataatttagataaataaatcatccatccatacattgataaatgatttttagaaattaacaacaaaatcaacaattttaaacatctctgtgattctatttattcgaaatgatttaaaaaataaaacttcaaaaacctaaccttatatttatacgaatacttagaggagcacaaaaatgaataaaaatataatcatcaaaagtattgcagcattgacgattttaacatcagtgactggcgtcggcacaacagtggttgagggtattcaacaaacggctaaagctgaacataatgtgaaactaatcaaaaatactaatgtagcaccatacaatggtgtcgtttcgataggatctggaacaggtttcattgtcggtaaaaatacaattgttaccaacaagcatgtcgttgcaggtatggaaattggtgcacatattatagcgcatcccaatggtgaatataataatggcggattttataaagttaaaaaaattgtccgttattcaggtcaagaagatattgccattctacatgtggaagataaagctgttcatccaaaaaacaggaattttaaagattacacaggcattttaaaaatagcatcagaagctaaagaaaatgaacgcatttcaattgttggctatccagaaccatatataaataaatttcaaatgtatgagtcaacaggaaaagtgctgtcagttaaaggcaacatgattattactgatgctttcgtagaaccaggcaactcaggttcagctgtatttaacagtaaatacgaagttgtaggtgttcactttggtggaaacggccctggaaataaaagtacaaaaggatatggtgtttatttctctcctgaaattaagaaattcattgcagataacacagataaataaatccttacatagataaatgattttaaaaattaacaacaaactcaacaattcaaatcatctctgtgattccatttattcgaaatgattaaaaaaaataaaacttcaaaaagctaacattataattatacaaatacttagaggagcagaaaaatgaataaaaatataatcatcaaaagtattgcagcattgacgattttaacatcaataactggtgtcggcacaacaatggttgaaggtattcaacaaacagccaaagccgaaaatactgttaaacaaattacaaatacaaatgttgcaccatacagtggtgttacatggatgggcgctggaacaggatttgtagttggaaatcatacaatcattaccaataaacatgttacctatcacatgaaagtcggtgatgaaatcaaagcacatcctaatggtttttataataacggtggtggactttataaagttactaagattgtagattatcctggtaaagaagatattgcggttgtacaagttgaagaaaaatcaacacaaccaaaaggtagaaaattcaaagatttcactagtaaatttaatatagcatcagaagctaaagaaaatgaacctatatcagtcattggttatccaaatcctaatggaaataaactacaaatgtatgaatcaactggtaaagtattatcagtgaatgggaatatagtgtcatcggatgcaattattcagcctggtagctctggttcacctatattaaatagtaaacacgaagctattggtgtaatctatgccggtaataagccatcaggtgaaagcacaagaggatttgctgtttatttctctcctgaaattaagaaattcattgcagataatttagataaataattaaaacttagacattcacccaatcctgacaaaatatactataactaacatttattaatatatattgcattatttaatatgcatcaaagccaatcaacgattgattttcaccaactcaattgttgattggttttatttatgtatgaatgaacaactttttgacatcattaagaatataaatgattttgaaagcatttgaaagctacaacatttctataaaatttttcaataacaattgcgccactaaaactcaaaatttccaccaccaacatccaaattatcaacatcgcaacataaccaaatgttataataaatctattacacaaagagataaattacttatgcaaaggcggaggaatcacatgtctattactgaaaaacaacgtcagcaacaagctgaattacataaaaaattatggtcgattgcgaatgatttaagagggaacatggatgcgagtgaattccgtaattacattttaggcttgattttctatcgcttcttatctgaaaaagccgaacaagaatatgcagatgccttgtcaggtgaagacatcacgtatcaagaagcatgggcagatgaagaatatcgtgaagacttaaaagcagaattaattgatc

SEQ ID NO: 32 - DNA, 2033 bp, Staphylococcus aureus
gatctggaacaggtttcattgtcggtaaaaatacaattgttaccaacaagcatgtcgttgcaggtatggaaattggtgcacatattatagcgcatcccaatggtgaatataataatggcggattttataaagttaaaaaaattgtccgttattcaggtcaagaagatattgccattctacatgtggaagataaagctgttcatccaaaaaacaggaattttaaagattacacaggcattttaaaaatagcatcagaagctaaagaaaatgaacgcatttcaattgttggctatccagaaccatatataaataaatttcaaatgtatgagtcaacaggaaaagtgctgtcagttaaaggcaacatgattattactgatgctttcgtagaaccaggcaactcaggttcagctgtatttaacagtaaatacgaagttgtaggtgttcactttggtggaaacggccctggaaataaaagtacaaaaggatatggtgtttatttctctcctgaaattaagaaattcattgcagataacacagataaataaatccttacatagataaatgattttaaaaattaacaacaaactcaacaattcaaatcatctctgtgattccatttattcgaaatgattaaaaaaaataaaacttcaaaaagctaacattataattatacaaatacttagaggagcagaaaaatgaataaaaatataatcatcaaaagtattgcagcattgacgattttaacatcaataactggtgtcggcacaacaatggttgaaggtattcaacaaacagccaaagccgaaaatactgttaaacaaattacaaatacaaatgttgcaccatacagtggtgttacatggatgggcgctggaacaggatttgtagttggaaatcatacaatcattaccaataaacatgttacctatcacatgaaagtcggtgatgaaatcaaagcacatcctaatggtttttataataacggtggtggactttataaagttactaagattgtagattatcctggtaaagaagatattgcggttgtacaagttgaagaaaaatcaacacaaccaaaaggtagaaaattcaaagatttcactagtaaatttaatatagcatcagaagctaaagaaaatgaacctatatcagtcattggttatccaaatcctaatggaaataaactacaaatgtatgaatcaactggtaaagtattatcagtgaatgggaatatagtgtcttcggatgcaattattcagcctggtagctctggttcacctatattaaatagtaaacacgaagctattggtgtaatctatgccggtaataagccatcaggtgaaagcacaagaggatttgctgtttatttctctcctgaaattaagaaattcattgcagataatttagataaataattaaaacttagacattcacccaatcctgacaaaatatactataactaacatttattaatatatattgcattatttaatatgcatcaaagccaatcaacgattgattttcaccaactcaattgttgattggttttatttatgtatgaatgaacaactttttgacatcattaagaatataaatgattttgaaagcatttgaaagctacaacatttctataaaatttttcaataacaattgcgccactaaaactcaaaatttccaccaccaacatccaaattatcaacatcgcaacataaccaaatgttataataaatctattacacaaagagataaattacttatgcaaaggcggaggaatcacatgtctattactgaaaaacaacgtcagcaacaagctgaattacataaaaaattatggtcgattgcgaatgatttaagagggaacatggatgcgagtgaattccgtaattacattttaggcttgattttctatcgcttcttatctgaaaaagccgaacaagaatatgcagatgccttgtcaggtgaagacatcacgtatcaagaagcatgggcagatgaagaatatcgtgaagacttaaaagcagaattaattgatc

SEQ ID NO: 33 - DNA, 2384 bp, Staphylococcus aureus
aaatattcgacaacatcgtctggtagacagtcaggacgcgtaccaatagataatcccacaacacccggttctttaagtacaggttcgaatttttcttttaatacttcaaccggtgcatgtgtatttgtaaatgcctgaaaataagcaatatattttccttcgtgccatttctcatgcatcttttctttaatttctttaaattgtactgcgattgaatctgcacgattacctgcaaagtctccgctacctgcagcagaacaaaatgtacatccaccatgtgctacagtgccatcgcggttaggacagtcaaacccgccatccaatgcaactttaaatattttttgtccaaatttattttttaaatggtaattccatgtgtgataacgtttgttttcaaaagcgtattggaaatgattgcccatatgtcattttcctttctataaaaaaagagttctaagtacagattttaacatattttaatgttatagtgtttattatagtttgacaaaaaagagagaggaactatgaaatatgaatatacctaaatcagtctggtggctagtaattggcatggcgttaaatattactggttccagttttttgtggcctttaaatacaatttatatgaaacaagaacttggaaaaagtttaactgttgctggtttagtgctaatgataaattcatttggcatggttattggaaacttattaggtggttcactatttgataaattaggtggatacaagacgattttaattggaactttcacttgtctttgtagtacaacgctacttaatttctttcacgggtggccttggtatgctgtatggcttgtaatgttagggtttggtggcggaatgattattcctgcgatatacgctatggctggagcagtgtggccaaatggcggaagacaaacgtttaatgcgatatacttagcgcaaaatattggtgtggctgtcggtgctgcaatgggcggctttgtcgcagaatttagctttaactatatctttttagccaatcttattatgtatgttgtgtttgcgcttgtcgcggtaacgcaatttaatattgaaattaatgcgaaagttaaatatccaactcatttagatattactggtaaaaagaataaagcaagatttatttcattagtactaatttgtgcaatgtttgcaatttgttgggttgcatatattcaatgggagtctacaatcgcttcatttacacaatctattaatatttcaatggcacaatatagtgttttatggacaattaacggaataatgattttagtagcacaaccattaattaaaccgattctctatctgttaaaaggaaacttaaagaagcaaatgtttgtcggcatcatcatttttatgttgtcgttctttgtcacgagttttgccgaaaactttacaatatttgttgtcggtatgattattttaacttttggagaaatgtttgtatggccagcagttccaactatagccaatcagttagcgccagatggtaagcaaggacagtaccaaggttttgtgaattcagctgctacagtaggaaaagcatttggtccatttcttggtggtgtattagttgatgcgtttaatatgcgcatgatgtttatcggtatgatgctactacttgtatttgcattaatattattaatggttttcaaggagaataatacgcaacctaaaaaaatagatgcataatgagtaaatagaattaacgttatagacttgaaataaatgtcgttataacataatattaatttgtataatttaatttcgtttggagcttttctacagaaagctagtgatgctgagagctagtgttaaggactaaatgtaaatcgtattaattttaaattgaatgaatgacatctcttactattaaaatgagtgcacaatttttgtgaaatagggtggtaacgcggcaaatgtcgtccctatgtaaatagaatagttagaggtgtcttttttattgaataggaggaaatgtgttgaattacaaccacaatcaaattgaaaagaaatggcaagactattgggacgaaaataaaacatttaaaacaaatgataacttaggtcaaaagaaattttatgctttagacatgtttccatatccatcaggtgctggtttacatgttggacatcctgagggctatacagcaacagatatcatttcaagatataaaagaatgcaaggatataatgtattacatccgatggggtgggatgcattcggattaccagcagagcaatatgctttagacactggcaacgacccacgtgaatttacaaagaaaaatatccaaacttttaaacgacaaattaaagaattagggttcagttatgattgggatcgtgaagttaatacaaca

SEQ ID NO: 34 - DNA, 3007 bp, Staphylococcus aureus
gatcttgcttgcgttttctaaacaatagtaatgatcctaataatgccatcattgcaccaaataaagttgcatttgtgttttcgctcttatctcctgtttctggtaaagcatcagttttgtgttgttttgataccttattagaatggtttacttcacctttaggatttgatggtgctttctgttcattatttggtggtgtaactcttgaatcggagtcactatctgagtctgagtcgctatctgaatccgagtcgctatccgagtctgagtcgctatctgagtctgaatcgctgtctgagtctgagtcgctatccgagtctgagtcgctgtctgaatctgaatcactgtctgaatccgaatcgctatctgaatctgaatcgctatccgagtctgagtcgctgtctgaatctgaatcgctgtctgagtccgaatcgctatctgaatctgagtcgctgtctgagtctgaatcgctatctgaatctgagtcgctatctgagtctgagtcgctgtctgagtctgagtcgctgtctgagtctgaatcgctatctgaatctgagtcgctgtctgagtctgagtcgctatctgagtctgagtcgctgtctgaatctgagtcgctgtctgaatctgaatcgctgtctgagtctgaatcgctatctgagtctgaatcgctatctgagtctgaatcactgtctgagtccgagtcactgtctgaatctgactcactatctgattctgagtcgctatctgattctgagtcgctgtctgaatctgaatcactgtctgaatccgaatcgctatctgattctgagtcgctatctgaacctgagtcgctgtctgagcctgagtcactgtctgaatccgaatccggatccgggtctgggcttggttccggttctgggtctggacttggttctggatctggcgttggttctggttctgggtctggacttggttctgggtcaaccggcggccctggagttgggtctttcggatttactgctgaatcaccatcagcacttccaccaccataacgtacaacattctcattattccaaccgaaaatactgtagtctctatttgttacaggatcaacattttcttgaataacctgagtttttaagttcttacctgtattgtcgtaatgcccttctactaatactacatatgttttagtaatatcaccaaatttaatactagctacatttggatgctcataatagattctatttttaaattggtctgttacttctttaaggttagagtcatttggatctgcatagtagctatctgataatttagatgtatcattcacttcaaaaattctcagttttgtatctgtagcacttactttaccgctactttcttcgattttatcttggtagcctttaatatacacccacgtattacctaaaactcgttgcttagggttaacaaatactgtttgcttgtatgtgttttgacctgaagctgtatctacaccaataatttgagaagaaatgttcgcgccatttggtttatcaattcctgcaattggcgaactatagttataagtaattttattattaaacatttcatccgcaatattaatattcgcatcatatgttcctgatttaggtgcctttgctcggtctgtaaataaaggtaatgaaaattgtccgttaatattttctttattatttacataatctgtaaagacaaatgtatacgtcttagtcaagatatcatatgttgctttagctacaacatcgccattcgtacttttaatgtctgcaattggcatcgtattatttgaattagaataatccacgtctccattaccagttaaactatctggtaacttcgctgtaaaataatcccctgatttcactttatctgtcactgtaaaatttgccgccataaatgtgttaccactttgattagggtcaaatgtagtcttttctaacttgaaattacttgccgtaactttatcatttacatttgtacctttagcatcagcagcatttactaccggttcagcaacagctaaactacgtacagctctcgttctaacacttggtttactagttccttgcgcattggaaatcgtttgtggtgatgattgtggtaaatctaatgtttgagaatttttaagctcactgtttgttgctatgctattagcatcattcgttgttttattatctacttgagaatttgcttcttgaggaacagtttgatcttgcatttttgcagcagttgcttgatttttaattgccgtcggttgaggtgtttcatttgttgaagctggctctgttgtagtggtattgctcgtttgtgtagacattggttttgttgtgctatctacattcgcactgtttgtgtttgcactaatatcagatgtatcattagccgttgtatttaattgaggtgtttctatcatattgtttttttcggaatctgcacttgcattatttttcgaagattgcgttgtatcgttcgattgttctgaagcttgtgcttgatgattgcctatcccaaatagtatagttgcccctactattactgatgtggtacctactgtaaaacgtctaatcgaatacttattctgcttattcgacaaataatcaattctttttttcaaaaatattactccatttcaatttctagattagtctaaattgtataatgaaataagaattatatcaattgcttttcgaaaaaaattacgtaaaatttgttttcttcctatttatataacttaaaattttctgttaactagcaaaaatcaatatactatttttacactattacaaattttttacttttcaaaaacttagaagttctaaatttttcatcaccttaaattttactgtaatttcaacaatcaaatttaactaacattttaaattattcatcatgctagcaaaaaaggcctaacgtataaatgtacgttagacctcatgttcaacttattcattttacattgtatattaaacacatacatcattgaataaatgtttgcttactaacc

SEQ ID NO: 35 - DNA, 2582 bp, Staphylococcus aureus
gatccacattgggcataatcacagctaatttgtgttcattcgcatacctttctatgcttgtatatctcatatatgtcgtttcatcacttgataatccatgtaacaacattaaagtttttaatggtttaacagttgtatcgctattaaagaagctttgatcttccggtaaaatgactgtcaaattttgatgcataccaattgttggtgaatgatagtttaatgaaatataagccatacgtcatgacccctttctaattctactttatcaacattttacgcttaatcaattcactttaaaatcattttcaacaaaaaaaccgaatacaaatgtattcggcctaaaaaagtatttacgctttttctttatgatcttgcttgcgttttctaaacaatagtaatgatcctaataatgccatcattgcaccaaataaagttgcatttgtgttttcgctcttatctcctgtttctggtaaagcatcagttttgtgttgttttgataccttattagaatggtttacttcacctttaggatttgatggtgctttctgttcattatttggtggtgtaactcttgaatcggagtcactatctgagtctgagtcgctatctgaatccgagtcgctatccgagtctgagtcgctatctgagtctgaatcgctgtctgagtctgagtcgctatccgagtctgagtcgctgtctgaatctgaatcactgtctgaatccgaatcgctatctgaatctgaatcgctatccgagtctgagtcgctgtctgaatctgaatcgctgtctgagtccgaatcgctatctgaatctgagtcgctgtctgagtctgaatcgctatctgaatctgagtcgctatctgagtctgagtcgctgtctgagtctgagtcgctgtctgagtctgaatcgctatctgaatctgagtcgctgtctgagtctgagtcgctatctgagtctgagtcgctgtctgaatctgagtcgctgtctgaatctgaatcgctgtctgagtctgaatcgctatctgagtctgaatcgctatctgagtctgaatcactgtctgagtccgagtcactgtctgaatctgactcactatctgattctgagtcgctatctgattctgagtcgctgtctgaatctgaatcactgtctgaatccgaatcgctatctgattctgagtcgctatctgaacctgagtcgctgtctgagcctgagtcactgtctgaatccgaatccggatccgggtctgggcttggttccggttctgggtctggacttggttctggatctggcgttggttctggttctgggtctggacttggttctgggtcaaccggcggccctggagttgggtctttcggatttactgctgaatcaccatcagcacttccaccaccataacgtacaacattctcattattccaaccgaaaatactgtagtctctatttgttacaggatcaacattttcttgaataacctgagtttttaagttcttacctgtattgtcgtaatgcccttctactaatactacatatgttttagtaatatcaccaaatttaatactagctacatttggatgctcataatagattctatttttaaattggtctgttacttctttaaggttagagtcatttggatctgcatagtagctatctgataatttagatgtatcattcacttcaaaaattctcagttttgtatctgtagcacttactttaccgctactttcttcgattttatcttggtagcctttaatatacacccacgtattacctaaaactcgttgcttagggttaacaaatactgtttgcttgtatgtgttttgacctgaagctgtatctacaccaataatttgagaagaaatgttcgcgccatttggtttatcaattcctgcaattggcgaactatagttataagtaattttattattaaacatttcatccgcaatattaatattcgcatcatatgttcctgatttaggtgcctttgctcggtctgtaaataaaggtaatgaaaattgtccgttaatattttctttattatttacataatctgtaaagacaaatgtatacgtcttagtcaagatatcatatgttgctttagctacaacatcgccattcgtacttttaatgtctgcaattggcatcgtattatttgaattagaataatccacgtctccattaccagttaaactatctggtaacttcgctgtaaaataatcccctgatttcactttatctgtcactgtaaaatttgccgccataaatgtgttaccactttgattagggtcaaatgtagtcttttctaacttgaaattacttgccgtaactttatcatttacatttgtacctttagcatcagcagcatttactaccggttcagcaacagctaaactacgtacagctctcgttctaacacttggtttactagttccttgcgcattggaaatcgtttgtggtgatgattgtggtaaatctaatgtttgagaatttttaagctcactgtttgttgctatgctattagcatcattcgttgttttattatctacttgagaatttgcttcttgaggaacagtttgatc

SEQ ID NO: 36 - DNA, 1267 bp, Staphylococcus aureus
gatccatttgtccctaccgctcgtcttacatcaagtttaccttgctcatttaatggaaaatgagtttgtggatggtctacataagcacgcacctcgcctttagcatttgcatcggcaataattcgtccaataggtccttggccatctacagtgacagttaatttttgatcacctttcaacattgcgcccatcatagctgttgctgtcattgttcttcccattgcagcagatgctgtcggccatgtataatgtctcgtttgtgcttcttgaacagtttcagttgtcaaagcagcataagccctaatctctccatcaaatgctaatgctttaacaatataatcgtgtgtcattatttcaatctcctctattactctatatttaaaaaattactttacttcataaaatgcaacaattgtacttattctacacccatcattctaaataatgaagtaacttgttttacaattattttctgctataacaattcaacgacttaaaatctaatacgtattttcaaaaacgataaaagtacctctttctataactttatcatagaaagaggtactgaatataatcgattatttattgtctgggtgatttggatcgtaaggtttttcgatatttggggcttgtcgatgtgctggttcatctttttcatcagatttatcagcttcttttttatcctcagcaatatctttttcttctttacgatcttcactttcgtcacgttgtccatcttctaattgctctttacgaatctcttcataagatttaccgaatttaccatcattaaattcagaatcttcatctttaacaactttagctgcatcataatcaatttcaggtaatttaccttcgtagaataatgattgaatttgttcagcaactaatgtttcttctgttaataatgtttcagcaattaaaattaattgttctttgtgctctaataaaatttgtttacaacgttcgtattgttctttaacgattcgttgaacttctttatcaatttcatatgcgatttggcttgaataattaggctcaccttgcatatctttacctaagaatacttgaccattgctatgaccgaactgtaatggtcctaattttttactcataccatattgcgtaaccattgagcgtgcgatttgtgttgcacgttcgaagtcatttgaagcacctgttgatacttcgttaaagttaatatcttctgatacacgtccaccaagtaaaccacagattttatctaataactcttgttcagtcatta

SEQ ID NO: 37 - DNA, 1236 bp, Staphylococcus aureus
acgatggtgtcttgcaacatcgaaaataatgttgtgtaagaacgttgttctaccatatcctggacttccgattaacgcgatgtgcccagcttttttcaattgcaataccatcggtccttgatattgttcttctggtacgtctttaagtcctaatgttaattccacttcttttgcatcatctgaccataattttctgaaatctgtttctactaaatcttcttgatatacattttctggcaatggtggtagccatggacgcttaacttcttcgatttctaatcgtgttgtaatagattcgatatgatctatgaccgcttctaactcagtttgattttctttcgtttcttcatcttcaagtccactcaagtctttgttgattgcttgaagttgaccatagtcattaatcatgtaaatcgtcttatcttcaacttctaatttatcgccttcgatgtcatatgttgcaccactccatgcagattggaataattcataaatttcattattaccaacttgtaaatacgcacgacctggtaatgtaatgtctgctgcatctggtgtttttaaaatttcattactgtcttgtctatcttgtacttttaatgccaacttaaatttagagttagaccaaatttggtcatcaacaacacccgatggtttttgtgtcgcaagtattaaatgaatacctaacgaacgtccaatacgtgccgttgatacaagttctttcataaaatcaggttgttctgattttaattcggcaaactcatcggaaataatgaataaatgtggcattggttctgtcgcaataccttctttaaataacttatggtattgattaatatggttaacatcatgctctccgaataaacgttgacgttttctcaattcggctttgattgatgttaaggcacgcatcgcttcatcgccatctaagtttgtaatcgtaccaactaaatggactaaatctttaaataagttcgccatacccccacctttatagtcaatcaataggaatgcaacttcatgagggtgaaaattaatagctaaagataaaatgtatgattggataatctcagatttccctgaaccagtggtaccagcaactaaaccatgtggcccgtgtgctttttcatgtaagttcaatgataaaatatcatctttacctcttacacctaaaggtactgccatcgttttgtatgtttcgttttgtctccatcgattaaccacatcaagctgatc

SEQ ID NO: 38 - DNA, 2901 bp, Staphylococcus aureus
gatcagatagataaagtattttctttttattatgtttatcagaatatgcgccaccgaaaataccaaatataataaatggaagtgtttgactcataaccatcattgataattttaaagatgattggtttgtcaattcaacagtaaaccaaattatttgtaacgaaaacagcacaaaacaactccgacgtaagaaattaccaatcaataaatatgtaaagtttctatttttcaaaacttctaaatacaacatatttatcacctctcataaaaataattgaatgcatccaccagcttttttagaccttcttctaaactctctttatccaaagcgcaattaattctaatataatttagtcagttaaatatcaattatttcgaaatatacatactacttgaaacaccatacataacccccaaaatgactactcagaggttatattctactaattatgattatattaaatatgaaaatattatcaaaaaaatcaaatttataacaaaaatacaccccttaaagttaggtctttcaatccaacttttggggtgtatatcattctcatcatattctaggttgtttttaacaaactaaatatagtgaatgcaaatcaactattatttaaattatgaattattttaattctttcttctacgagccaataacattaatccagcaattccaattatactactaaagatcaaacctttttgcgtgctttctaaacctgtttttggtaattctgctcgttttttctcttgattagctactgattctttagcaattttagattttttaactttatcatttttatccattgaatgaactgggccatttggttttgctctgtctttcgataatcctggattgttaggatttactgggccacttggatgagttggtctgctcggcttctctgggttttcaggtccttttggatcttttggtttctctccaccgaactctacaatcttatctactggttgttttgtgatctcttctgttggttgaccctcgccaactttttcacctgttaatgggttcactgtgattggtgttgtgattgtcttacttcctggttgtccttcttgtttcactcgctcttcaccaggttgtaattttggattaaactcacgttttgtttcaaacggtatctctactgtttttgtttctggtgtacccgtttttggtccgtgtttaatcacatcatccactggctcttcgatcacttttcctgtgtctggattcttgattcctggtttacctggtactttttccgtttgatctgttggtaagtttggatcaaagatatctttatgaccttgcggtattttctcgccaccgaattctgttaattcattaactggatcttttgtgatttcttctttcgattcacctttactaataatttctccagttaatggattttttagtgttggcgtcgttattgtcttctcacctttttgtccttctcttgttactttttctgtccctggtgctaaatcaggattaaatttacgttctttctcgaatggaatttcttctttttctacaatcgagtctccttttacaggtccatattttgttacgctatcgaccggtggtctaactacatctcctgtttctggattcttaattcctggtttacctggaacttcctctttctctcctgttggtaacttcggatcaaattcgtctcgatgacctggtgttatcgtttctggtccgtattctgttaattcattaatcggatcttttgtgatttcttctttcgattcacctttactaataatttctccagttaatggattttttagtgttggcgtcgttattgtcttctcacctttttgtccttctcttgttactttttctgtccctggtgctaaatcaggattaaatttacgttctttctcgaatggaatttcttctttttctacaatcgagtctccttttacaggtccatattttgttacgctatcgaccggtggtctaactacatctcctgtttctggattcttaattcctggtttacctggaacttcctctttctctcctgttggtaacttcggatcaaattcgtctcgatgacctggtgttatcgtttctggtccgtattctgttaattcattaatcggatcttttgtgatttcttctttcgattcacctttactaataatttctccagttaatggattttttagtgttggcgtcgttattgtcttctcacctttttgtccttctcttgttactttttctgtccctggtgctaaatcaggattaaatttacgttctttcttgaatggaatttcttctttttctacaatcgagtctccttttacaggtccatattttgttacgctatcgaccggtggtctaactacgtctcctgtttctggattcttaattcctggtttacctggaacttcctctttctctcctgttggtaacttcggatcaaattcgtctcgatgacctggtgttatcgtttctggtccgtattctgttaattcattaatcggatcttttgtgatttcttctttcgattcacctttactaataatttctccagttaatggattttttagtgttggcgtcgttattgtcttctcacctttttgtccttctcttgttactttttctgtccctggtgctaaatcaggattaaatttacgttctttctcgaatggaatctcttctttttctacaatcgagtctccttttacaggtccatattttgttacgctatcgaccggtggtctaactacatctcctgtttctggattcttaattcctggtttacctggaacttcctctttctctcctgttggtaacttcggatcaaattcgtctcgatgacctggtgttatcgtttctggtccgtattctgttaattcattaatcggatc

SEQ ID NO: 39 - DNA, 1540 bp, Staphylococcus aureus
gatcaaattcgtctcgatgacctggtgttatcgtttctggtccgtattctgttaattcattaatcggatcttttgtgatttcttctttcgattcacctttactaataatttctccagttaatggattttttagtgttggcgtcgttattgtcttctcacctttttgtccttctcttgttactttttctgtccctggtgctaaatcaggattaaatttacgttctttcttgaatggaatttcttctttttctacaatcgagtctccttttacaggtccatattttgttacgctatcgaccggtggtctaactacgtctcctgtttctggattcttaattcctggtttacctggaacttcctctttctctcctgttggtaacttcggatcaaattcgtctcgatgacctggtgttatcgtttctggtccgtattctgttaattcattaatcggatcttttgtgatttcttctttcgattcacctttactaataatttctccagttaatggattttttagtgttggcgtcgttattgtcttctcacctttttgtccttctcttgttactttttctgtccctggtgctaaatcaggattaaatttacgttctttctcgaatggaatctcttctttttctacaatcgagtctccttttacaggtccatattttgttacgctatcgaccggtggtctaactacatctcctgtttctggattcttaattcctggtttacctggaacttcctctttctctcctgttggtaacttcggatcaaattcgtctcgatgacctggtgttatcgtttctggtccgtattctgttaattcattaatcggatcttttgtgatttcttctttcgattcacctttactaataatttctccagttaatggattttttagtgttggcgtcgttattgtcttctcacctttttgtccttctcttgttactttttctgtccctggtgctaaatccggattaaatttacgttctttcttgaatggaatctcttctttttctacaatcgagtctccttttacaggtccatattttgttacgctatcgaccggtggtctaactacgtctcctgtttctggattcttaattcctggtttacctggaacttcttctttctctcctgttggtaacttcggatcaaattcgtctcgatgacctggtgttatcgtttctggtccgtattctgttaattcattaatcggatcttttgtgatttcttcttttggttcacctttactaataattactccagttaatggattttttagtgttggtgtcgttattgtcttctcacctttttgtccttctcttgttactttttctgtccctggtgctaaatcaggattaaatttacgttctttctcgaatggaatctcttctttttctacaatcgagtctccttttacaggtccatattttgttacgctatcgaccggtggtctaactacatctcctgtttctggattcttaattcctggtttacctggaacttcctctttctctcctgttggtaacttcggatc

SEQ ID NO: 40 - DNA, 1471 bp, Staphylococcus aureus
gatcgataaaatagtttatgccttgggcgaaaccaggtgaggttttgacgataatgtatgaaccattgatgattgaacttagaacttcatgttcacaatagtgtctaaacttttctctcatctcttgttctgtttgattattaatagctttataaatccatgtctcacaatcgatagggacacgatatatatttagttccttcaagtctttagcaattgttgttgcactatatcttacaccaaaatattcttcaatatatgaaatgatttgttcttttttataaatcttatgctttttaactattgtagaaacaatttctaatcgtttacttttcttcatattgtaaactcctttggtagttacgtttcttgtattaaaaaataaattcatgcatgtttcatttataatttaacactttgttttgcaaaagataataaaaatacatgtaaattttttgtgacaacttttaaaatgaattttgtattctaagtcagcatttaattatcacatatctactacttgtaatgattttagactgccgagtagtctttcggcagacaaccctcacactcctctcatctaattacaaagagagggtatacctacaaagtcaattatcaatgtaggtataccccatatataagctgtatttaaaatttaattatttataagtgtttaacattacttcttcttgtttatatatttttactccacgcctacttcattccatgcttcatacacctgttcagctgtttgctcgtcatataaatctttagccgcttggtataatgcatctttacaatctttgaagtttgaattacttgttaagtattccgttaatgctcggtagtaaatttgttctgatttagatttccctattgcttgaatcacgttataagctgctttatttggaattccagaattcgtatgtacgccaccattatctttttcagtgaatacatagtctttcatatgagctggttgaccaaattgttctgggtttgacatgctgcgtaaagcgtctccctcttttccaggtgtgtagacatcttcacccattaagaaatcctcgtcatctacaaagtatccaaaaacatctgaaaagctttcatttagagcgcctgactggtccttatattctaagttcgctgtctcttgtgtcacaccgtgtgttaattcgtgtgctactacgtcatttgcacccgataaacttgtgaatgtgcgaccatcaccatcaccatagatcattttgtcaccgatccatgcggcattatttctgttatcttgaccaccgtagttattaacatgcgttaatgaaacaattggactaccttggttgtcatatgattcacgaccaaatgtgtctttgtaataatcatatgtttgtttagcgtaataatttgcatctacgccagcacgttgctcatcttttacgaagttttcatcttcattagtaatcaatgttgcttg

SEQ ID NO: 41 - DNA, 1439 bp, Staphylococcus aureus
gatcctttgtcactacctgaagcagaatttttatcatctttacctggtgcattagcacctgctacatcagttggtccattaaatttatatgtaatgttgtaatgatggtcatatttgaatggctttccatttactttttcatcgatataaacgtcaatttttccatctattttaccgttcaacttacttacttcaaattcagaagtgcgttcatctttggcagtgtttttactaataatattttctttatgtccttcgatactcattccagtaatccaatgactgtggttgacagttatttgaacatacaatttaccatttttcttaatgtactttgccggtttattaaaatagtcattagcaattgacgtgtcattggtattgtatttgtaaacctcataattcaaagtaccgctatctgcggcatttgcagaattactgaatgtcgcgatgatgataattaacgctaaaatcgttgtattaaaaacttttaaaatatttttcaaaacataatcctcctttttatgattgcttttaagtctttagtaaaatcataaataataatgattatcattgtcaatatttattttataatcaatttattattgttatacgaaaatagatgtgctagtataattgataaccattatcaattgcaatggttaatcatctcatataacaacacataatttgtatccttaggaggaaaacaacatgacaaaacattatttaaacagtaagtatcaatcagaacaacgttcatcagctatgaaaaagattacaatgggtacagcatctatcattttaggttcccttgtatacataggcgcagacagccaacaagtcaatgcggcaacagaagctacgaacgcaactaataatcaaagcacacaagtttctcaagcaacatcacaaccaattaatttccaagtgcaaaaagatggctcttcagagaagtcacacatggatgactatatgcaacaccctggtaaagtaattaaacaaaataataaatattatttccaaaccgtgttaaacaatgcatcattctggaaagaatacaaattttacaatgcaaacaatcaagaattagcaacaactgttgttaacgataataaaaaagcggatactagaacaatcaatgttgcagttgaacctggatataagagcttaactactaaagtacatattgtcgtgccacaaattaattacaatcatagatatactacgcatttggaatttgaaaaagcaattcctacattagctgacgcagcaaaaccaaacaatgttaaaccggttcaaccaaaaccagctcaacctaaaacacctactgagcaaactaaaccagttcaacctaaagttgaaaaagttaaacctactgtaactacaacaagcaaagttgaagacaatcactctactaaagttgtaagtactgacac

SEQ ID NO: 42 - DNA, 2407 bp, Staphylococcus aureus
gatcaatactattttcacctgtcgttttcgcttggtctacatcattttgactattagcagcttcaatgttgctatttgcttgtgtcacagcattatctacgtccgcattagccgctgcaatttcttcagcagtaatgtcttgcgtttgagcgattgctgttttacgttcattcgctttcgtagcaattgcttctttcgcattatctttagttgttgttgctggctgaatcgcttcaattttagcaattgctgcttttttagccgcttcaacttccgcatttgtatgtgctgcatctattgcggcatcagctgttgttttttcagtttgaacttgttgtttagcagctgctttttcttcagttgttgagccgttatttccatcaattgctgtttcttgagcttgtactttatctgcaattgcttgttttgctgctggtttaacatttgcatcaggtgtaatggctgcgattgtagcttcatttgtagtttttgcattatccacatcattgtttgctgcagcattatctatatcagcgtttgcagtaactactgcttgatccactttgtctttcgctgcttgttgttcttcagtagtcgaatcattcattgcttcaattgctgttttacgttcacttgctttttgagcgatttccgcttttgcatccgatttcttagttgtggcagcttgaacttgattaattgcagcaatactattgtctttagctgttgttacatcactgtttgtatttgcagcatcaagatttgttcttgcttcttgctttttagtatctaattctgtatatgcagcttgtttttcttctgtagttgaagcattgctattttgaatttcttgtttacgtgtattatatgcgttttctacttccgtatcagctgcaggtttaacttttgcttgtgtttgaattgcattgattttatctaatacttttgattttgtatcagcaacttcctgttttgatttaacaacttggatgtcatgtaaaccttgcttttgagctgcatctactgctgcatcagcttctgctacttcttcatttgttgcatttgaaactgtagcattttgagcttttctagctgttgcagcttgtttaacttcattataggcatccatttttgtttgcgtagagtcagtaatattttcaatttttgagatttcttcgtttttaactctttctaaatcttgtgcagtcgttgtcgcttcaattgctttaacaccagaaactttagctgcattaatacgttcaatagcttccgctacttcttcatttgttgtatcaggatttaaaggtgcttgatcaatttgtgcttgaacaacttcgtcaaattcttcaagagctgctgctttagctgttgtagcaggtgtagtttgattaatatcattgattgcttttgttttaatggcttctacttgtgcatttgttgttgctgcatcaatatctttaattgcctttgtttcaattttaccaattttatcatttgctacatctttttcatcttgtaatgatgcatttgactttttaatttgttgtttacgagttgtaactgcttggataatatcttgtttcgcttgaggtttaactgttggtgtaatcacatcttgttctaacactgcgataccattatctttttcagttgtgacaccttgtgctgtagtttgtttattaatttctgcgattgcattatttttatcattgttaattttagttacaagtgctgcaacttcatcttgcgtaacttttttactttgttgtgctgctgtaaccttttcttgagctttagtatctaattcagcaattgctgcttgattatcaattaatgcagcttgtaatttagttactaaaccatcaatatccgcttgagatgcacgatttgcagttttaacatgattcgcatcttcatttaaaatagtatctgcttgttgtttaagtttattgtattctgcaattgatgctgttgtgtaatgactattatcaacttgtgagtttacttgttgttgcaacgcatctttgttcatttcaaccgctactgaaaatggatctgcagttagtgtaacttctggttgcgcattattaattacaacatctgaagcagtacgatatgttaatttttcattaaaatcaatatttttaggtgtatcgatattcgcaacattaactttatatgataattttaaagatttatctgggaataaaacttctttagtgtgtgtaccacgtgccgttgtcacaccttggcttgtaaatgtaactttatttgcattttgatcataattaacagtcatatttttcaatactgtactgtcttcattaccattagggaatgttgtagttaatgaattattaacgtaagttacaccttgtggtaatgttacttcatatttaaattgatc

SEQ ID NO: 43 - DNA, 4965 bp, Staphylococcus aureus
caattcttatttatctgatgaagtaacacgtgtcggacgaggtacattacgtaaaattggccctaaagatagaattataaaaccattaacatatctttataataaagatttagaacgcactggtttattaaatacagctgcattgttattgaagtatgatgatacagcagaccaagaaactgttgagaaaaataattacattaaagaacacggtttaaaagcgtttttaagtgaatatgctaaagttgacgatggcttagccgatgaaataattgaagcgtacaattcactttcataatttattgagctttgtttgaaacaagaagtttccaacgttattcgttaacaatcagtaataatgtagtagttcccttgaattaacaatattaaatttctgaacataaaaaatactcccttcaacatagacacttaacttgtgttatgtatgaaaggagtatttttgcgttaataatttgttttattttcgagccacagccacctattcaatggctattggtcattactaaaacaaattcatattaactgttagacttggttacttagtaaggaatatttccctatgaaataactagatgttcacattcttgaataaattttattcttcagtttgttggtctttcttagtgaatcttctaattaagaatgccatacctgcacctagagctaattcagcatatggtaaatcgtcattatgtgacataccagtatctggtaaagttttagcttgttgtttagctttattaacttttccttgttgagctgattttgtcttagcttggtggtcgtcagtgttagttacattaagcatatcttgattagcactattgcttccatttgaaactgtagctggagatgcattggcaccgtcgttttgcgtagctttattgtttgcagctgaaccaactgatttttgcgtatcattagtatctgctgttgccgtatcatctttttggctaacattagttgaagtcattttttcttttgcttcagaagatgcagatgttgatggtttattcgaaacttcagtatcagctttgcttggcgatttatctgcttcgttagatgcaacgttagtttcagacttaagttgtcctgcatcagtttgatttgtcgtactttcttctttatcttttgatgtattagaaggtacatttggttctgttatgtctgctgaaggcaatgtttcagttgttgattcaaccatactttgatttgttgaatcactaccatctttttctgccttagctttattttcagattttggttgtgcaaccttgtcattagttgattgagattcagcactattatttacttcagcattttgttttgaatcatttacagatgcattatctttgctatcagcagatgatgctgcttctgtgctcgcagttgttggagccgttgctgttgatcctgttggtgcattctcgtttgttgctgtagttgtactattgttatttgttgtgctttctgctggcgttgcattatcagtttctgttacaggtttatcagttgtgccgttattagttgattctacttctggtttactagttacatcgttatccattgtcggactgtttgttgatgcatctacactagaattgttattagcttgcggtttatcatttgcatcatcagttgctgatgttgctgttgtttcacctgttgccgcatcactattatttggtgttgtcggagaagcgtctgctttgccattagctgtcgtctcagatacgttaggttgtccagtattttctggtgttgcattagcatttgaatttgctgttgcatcattattatctataccattattagtatcattagcatctggatcattctgaggcacaatcgcttcaattgcaggtatcgttacattttgtaattcagcaacttctgcatttgtttgtgttttatctaatttatcagcaaatctgtcaaaatatctacctaaatccgtacgtgcaatttctttcgccgatgcatctgcatctgcatttttaattatttctatttgcttgttaaccacttctctgattgcttccaaagcatttttcttaacttcaggattaatacgttgtgctttaagttgttcaagcgcactatttttgacagtagcgatttctgcatttgtagtttgatcagaaatatcttcagttgcttttgataaaatgtcttctaaagcattcgtaaacgcttctttttcttcagttgtagcatcagcgttgacatttacacctgcttcaatctggtctagtgcagtttctaattcttcgatagctttttgtttttctgttgagtcgatttgaatgttatcaaatgcttcaagtccttgagctttcgctttttcaacttcagcagttgttgttgcatcagtaataccttgtttagcttgatctgtaatttgtttaatcattgctaatgcttcagttttttcttcagcagttaactggtcactttgatcaatagattctttcgtatcttctgctttaacttcaatagcttggttcgctttaggtttaacagtagcatctacttgaatagcatcaattgctgctttaccttgtgttaatgcatcatcaacgtcaccattatccacaccattattaatgctttctaatgcagtttgaacattttggtcaacttgcttaattgcttgttgcttttcatcttgtgttgcattagtgtcagctgaaatattatttttcttctgatctgcataagcatataaatctgttgtagctgattcttttttacctgttggaattgtgtaatcgttaatattatctaagtcattatgaatttgaacttcaatgtcatctttagaagtagcttgattaacattttgatccgcagtttgttttaattcagcaagtttttgtttcgcttcagcaatttcacttgaagtcgatgcgttagagttatccgcttcgtttactttagcattatatgcatcttcaattttagctaaagcatcttttttgtactcactaaatgttttaactgcattaattttagcttttccttctttaactgcattatcaacatattcatttgttgatgattgatcgacatttgttttcgcttgatttaattcagtatcaacttcttgttttgcatcattaatttcttgttgtgatgcatttggtgtttgttctatttgtgttttcttatcagctgcagcttgatctaattcttttttacctgctggtttcttaacaggatttgcatgaagttgttgaactttttgtactgctgtatctttagcagtagttacatcacctgtagtagttgctgcattaatattatttaaaccttcttcatatgctgctctaactggtccaatatcgttacctttttcttcattagtagtctcattattattaagtatttcagttattttattttgcatttcagttagcaattccgctcttgcattcgttttaacatctgttgatgcttgaattgggtcaattgcttgaattgcattatcttttgcagtgtttacatcatcgattgactgtgcattttcaatattttgattaccttgtgttaattgtgcgtctacttgttgatttgcttgttctttttcttcagtagtcgcatctgcagtttgtgcaataagcgctttttgttcgtttgcttttgttgctaattcatctttcgcaacatctttaattgttgtatctgcagtaataccttgaatatcagcaactgcttgatctttaatttgcgtaacatcattagttgtttgtgcatttaagatatcttgatacgctttttctttagcttttaaaactaaatcttttgctgcatttttctcttcagttgtagcaccagttgtattatcaattgcttgattttgagttgtcacagcttgatcaacatcatttttagcatttgatttaaccgctgttgctggttgcgtgctttgaattgaattctttccagcgtctttcgcctgatctacaccattatcatcagttgcagctgtaatattatttttcgcgtctgtaactgctgttgctaattgttgaatagctgcttctttttcttctgttgtagcgttctgatcattattgataacatttgtttgcgttgcttgtaattgatcaatttcatctttagccgcttgtttcttcacaacttttggtgttaccgcattaatcgctgcttctgcatttgctttagcttcatcaacttgtgcgttagtagttgctgctgaaatggcttgatttgctttaccattttcagtatttgcttcagcatcagctgcttgtttttcttcatctgttgcatctggcgtagcttgaatctcttgcaatttgttatttaaaattgctgtgatttcattacgtgcagttgcttttttattaactgttggtgttacttgatcaatactattttcacctgtcgttttcgcttggtctacatcattttgactattagcagcttcaatgttgctatttgcttgtgtcacagcattatctacgtccgcattagccgctgcaatttcttcagcagtaatgtcttgcgtttgagcgattgctgttttacgttcattcgctttcgtagcaattgcttctttcgcattatctttagttgttgttgctggctgaatcgcttcaattttagcaattgctgcttttttagccgcttcaacttccgcatttgtatgtgctgcatctattgcggcatcagctgttgttttttcagtttgaacttgttgtttagcagctgctttttcttcagttgttgagccgttatttccatcaattgctgtttcttgagcttgtactttatctgcaattgcttgttttgctgctggtttaacatttgcatcaggtgtaatggctgcgattgtagcttcatttgtagtttttgcattatccacatcattgtttgctgcagcattatctatatcagcgtttgcagtaactactgctt

SEQ ID NO: 44 - DNA, 2112 bp, Staphylococcus aureus
gatcatctctatcaatttttatattaaattcatttttttgaatcgataaaataaactcgattagctcttccttataagacctattatattcaattatgtttatagccatttttatctcctttttcatttaatttaattataaaatgtgcgtttagtttgtatctagtgtactcagtacagcctcaaatgaagtttcattccacttggcacttaataaagacaagtattttagcagtaatacaataaagtccaataaatttccctaacttcaatatccactttttaaaaaatgtatttttaattaataaaaaaactctccccaatttctatgggaagagctatatatttaatgtctaaacattacttttatttattatgaaggaattagaatccccaagcacctaaaccttgtgctttgtatgctttaacagctgcgttgatttgttggtcaacagtgtttgttggaccccaacctggcatagtttggaataaacctgaagcacctgatgggttgtaagcatttacttgaccatttgattcacgagcgatgattgcagcccatgtagaagctgaaacaccagtacgttgagccatgatttgagctgctgatgaaccagtagcacctgcagtattaccattgcttaatctcactgaacttgaagtagttgaagtgctgtagttatggtaagttggagctgaaacagcttcaacgtttgagttacttgattgtgcattgtagcttactgattgtacatttgaaccttggttgtatgaagtagtgtagtctgcacctgcaacgtttgagaaaccagcagtttgaccattagctgcttcatagctccatgaccatgtagtaccatttgaagtgaagttatattggaaaccatcttttacaaagtggatgtcatatgcaccatctttgattggagctgcatttaattgatcttggtgattatgcgctaagtcaactaagtgtgcttgatcaacgtttacttcagcagcgtgtgcttgatgtcctgtacctgctgcgtaacctgttacacctaatgccactgctaatgatgatgccataattgtctttttcatagtaaaaaatcctccagtaataattgtaagtttatgtttttagtaattatattttgaatttgaatgtcgtagtgcaagtttaaattgtcttttatttctttcaacggtactcactatatcacaaaaaaccagccagtaaattacactttctttacaaaacattacaatatcaagtgttatttgtaatgttgaaatatggctgttttatactgtaatgtgaaatatgtgccctttagaatccaatcaacccttgaaatagtctttaacacataagatttttactatatttagctcaactattacagctttcgtaatattacagattgtatttttgttacatagctgtaatatatctgacatgtaacttctcttattttcgtacattaaacgcaattaaaaagcaatcaacaaatatgtttctacacatgtattgattgctattattgttgtatattcaaagttttaaaacacacatcttttgtgaattgtcttatcttttattagcgcaaataaactgcagctcaattatattgttcaacttcattctcgcaattcacaataacattaaataatttttggtctcatattttcaaaaaacatactgttattatcccatgaatttaaaaatatcattagtatataaacgaaacactttacgataaatgatatctgcaagccaagctgttacaaatggtacaacaaagaacgctactacaattagtaagacactcaaccaagcagaatcaacctccataaatttaaatgcattaatcggtcctaccattcctataaaaccaaatccagctgactctttcgttccatgaatacctactaatgctgataccaaacctgatacaatggctgtcgttaatattggtaacataagaattggatatttcaccatattaggtatcatcattttaacgcctccaaagaagacggataacggcacccctaaacgattcactttacttgtaccaattatcaatactgcttcagtcgcggagataccaattgacgctgatc

SEQ ID NO: 45 - DNA, 2105 bp, Staphylococcus aureus
gatctggcgttggttctggttctgggtctggacttggttctgggtcaaccggcggccctggagttgggtctttcggatttactgctgaatcaccatcagcacttccaccaccataacgtacaacattctcattattccaaccgaaaatactgtagtctctatttgttacaggatcaacattttcttgaataacctgagtttttaagttcttacctgtattgtcgtaatgcccttctactaatactacatatgttttagtaatatcaccaaatttaatactagctacatttggatgctcataatagattctatttttaaattggtctgttacttctttaaggttagagtcatttggatctgcatagtagctatctgataatttagatgtatcattcacttcaaaaattctcagttttgtatctgtagcacttactttaccgctactttcttcgattttatcttggtagcctttaatatacacccacgtattacctaaaactcgttgcttagggttaacaaatactgtttgcttgtatgtgttttgacctgaagctgtatctacaccaataatttgagaagaaatgttcgcgccatttggtttatcaattcctgcaattggcgaactatagttataagtaattttattattaaacatttcatccgcaatattaatattcgcatcatatgttcctgatttaggtgcctttgctcggtctgtaaataaaggtaatgaaaattgtccgttaatattttctttattatttacataatctgtaaagacaaatgtatacgtcttagtcaagatatcatatgttgctttagctacaacatcgccattcgtacttttaatgtctgcaattggcatcgtattatttgaattagaataatccacgtctccattaccagttaaactatctggtaacttcgctgtaaaataatcccctgatttcactttatctgtcactgtaaaatttgccgccataaatgtgttaccactttgattagggtcaaatgtagtcttttctaacttgaaattacttgccgtaactttatcatttacatttgtacctttagcatcagcagcatttactaccggttcagcaacagctaaactacgtacagctctcgttctaacacttggtttactagttccttgcgcattggaaatcgtttgtggtgatgattgtggtaaatctaatgtttgagaatttttaagctcactgtttgttgctatgctattagcatcattcgttgttttattatctacttgagaatttgcttcttgaggaacagtttgatcttgcatttttgcagcagttgcttgatttttaattgccgtcggttgaggtgtttcatttgttgaagctggctctgttgtagtggtattgctcgtttgtgtagacattggttttgttgtgctatctacattcgcactgtttgtgtttgcactaatatcagatgtatcattagccgttgtatttaattgaggtgtttctatcatattgtttttttcggaatctgcacttgcattatttttcgaagattgcgttgtatcgttcgattgttctgaagcttgtgcttgatgattgcctatcccaaatagtatagttgcccctactattactgatgtggtacctactgtaaaacgtctaatcgaatacttattctgcttattcgacaaataatcaattctttttttcaaaaatattactccatttcaatttctagattagtctaaattgtataatgaaataagaattatatcaattgcttttcgaaaaaaattacgtaaaatttgttttcttcctatttatataacttaaaattttctgttaactagcaaaaatcaatatactatttttacactattacaaattttttacttttcaaaaacttagaagttctaaatttttcatcaccttaaattttactgtaatttcaacaatcaaatttaactaacattttaaattattcatcatgctagcaaaaaaggcctaacgtataaatgtacgttagacctcatgttcaacttattcattttacattgtatattaaacacatacatcattgaataaatgtttgcttactaaccaatttttatgatc

SEQ ID NO: 46 - DNA, 701 bp, Staphylococcus aureus
gatcagctaacgctacaaaactaataacaaatgcgatgatgattaatactaatttacctgctgctaatacagaatctccaaggaatgagaagaatggttgacgttcaacttcattgtttttaagactgtaaataatatcttctttctcttcaacacttactggattcaacaagcatgacacaataatcgcgttaacgatatttagtggaattgccgttagtaccagttctcctggtaccatttgtacatacgcacctacaatagctcccgatacagagctcattgacatcattgcgattgttaatacacgcatttcattcatacgttttagttgctcacttgatacggctaatgcttcagtatttcctaagaacatcatttctatcccaaagaatgactcgaatttaggttgtcttgttactttagctagtaaccaaccaatacctccaataattttcggtaaaatattaaagtacattaagatatcaaataatggcactattaataatattgggaataaggctgcaacagccatatccatcattttaacatttgtcaaacttgcaaatgcaaaacctgtaccagcatgcgctgactgaactacccaagcgataccattggctgctcctcttactgctttttgaccccaatcaaaataaataaagaaccatgctaaaaacaggtttaaaacaactaagatc

SEQ ID NO: 47 - DNA, 2235 bp, Staphylococcus aureus
gatctttcgaaattgtttcttcaaaagtttttggatgaaaagttaatttttctggaaaacataactgttgtgccatatatccaaaactttcttgatattttttaaaattatcgaaattaatcacggaaaatccctccatagaaattctcattataaatttcttgaccagttttccctgaacctactgcaacgccacagccttcacagttatctccaaaatgctcgccgccgtaattgtatcctgtactaccttgtgcgtgatacgtatctaaataggtttctttgtgtgatgttggaataacaaatcgatcttcatatttggctagtcctaataaacgatacatgtctttagtttggcgctcggttatacctaatcgctctaatcgagacgtgtcaaatggctgttgagtaacttgagatctcatataacttctcatcattgccatacgttgtagggctccttttactggctctgtatctcctgcagtgaaaatattagctaagtattcaataggtaaacgcatttcttcaatggctgggaaaatcgcatctggattttgagttgtatttttaccttcaaaatagctcataattgggctaagtggtgggcaataccaaaccatcggcatcgttctaaattcaggatgtaacggaaatgcaagtttatattcaattgctaacttataaattggagagttttgtgcagcttcaatccaatcgtaaccaataccatctttttcagcttgagcaatgacttcttcgtcaaatgggtttaagaatatatctaattgtttttcatataaatctttctcgtctactgctgaagctgcttcatgaactcgatctgcatcatataataaaacacctaagtaacgcatacgtcctgtacaagtttcagagcataccgtaggcatacccgcctcgattctcgggaaacagaaagtacacttttcagctttgttcgttttccaattgaagtaaactttcttatatggacaacctgtcatacagtaacgccatccacgacatgcgtcttggtcaactaatacaatgccatcttcatcacgtttatacatagcacctgaaggacacgatgcaacgcaacttggattcaagcaatgttcacataaacgtggtaaatacatcataaaagtttcgtcaaattggaatttaatatcttcttctattttttggatgttaggatcttttggacctgtaacatgaccacctgctaagtcatcttcccagttaggtccccattcaatttcaatgttatcccccgtaatttctgaatacgctctagcaactggcgaatgcttccctgatttcgcagttgttaaatgttcataattatagttccatggctcataataatctttaattaatggcatatctgggttataaaaaattttacctaaagcaatttttgaaattctacttccagattttaattcaagtttccctttacgatttagtacccaaccacctttgtagtgttcttggtcttcccaacgtttcggataccctacacctggcttcgtttctacgttgttgaaccacatgtactcagcacctggacgatttgtccaagtgtttttacatgtcacactacacgtatggcatcctatgcatttatctaaatttaataccatcgcaacttgcgctttaatcttcaagccaattaacctccttcatctttctaactgctacatataaatccctttggttcccaattggtccataataattaaagtgataactaatttgtgcgtatcctccgactagttgtgttggtttcaaatggattctagtcggcgcgttgtgtgaaccaccacgtgtatctgtaatttctgacccaggcgtttgaatatgtttatcttgtgcatgatacataaacattgtacctttaggcatacgatgcgaaataactgctcttgccgttacaacaccattacggttatacacttctagccaatcattatcttggatatcgtgtttttcagcatcttcatttgatatccaaaccgttggaccacctctaaatagtgtcaacatatgcttattatcttgatacattgagtgtatattccattttccatgaggcgttaaataacgcagtaccaaagcatctgtaccacctttaattttcttatctctattcccaaataccattggcggcaatgtcggtttatatactggtaagctctccccaaattgttggaaaacttcgtgatc

SEQ ID NO: 48 - DNA, 3385 bp, Staphylococcus aureus
gattcatcaatacttttgaaacaccacctaatgatgcaatgtcttgttgggagtcacctaagtgtccggaatgatagataacaatattacctgtttcacgttttaaaataaaagatttaaatagaaatcgattatcaaaaggcagttccgaagtaggtgtcgcatataagttttttgtgatggattctaaactgtcatgtaatttggactgtttatttttaaattgattagtcattttatttcatccttcgattaatttgaattgtacatacgcagtaccctttatttaatttaataatcaatgagagtctttcaaacttcgatttagaatatgcttcatacaataaataagtacttggagcactaaaaaattaaatcttttagtacaacattaatgaaaacctaaaagttcatcctacaatgctactaaaaaaaggggaatggaacagaaatgatattttcacaaaattcatttcgtcgtcccagacccgctttgaattataaattatcgtcttgttcttcttctgatacttgaacgattcgcaatgaacgacgttcaacttcttttaatttttcagcacgcgtttcaagtttaattctatcgcgccctaaaatgattaaaaatgatatcatcatgaaaataaaaataacaattaatggcacacttgccagtattgaagcagttttcaatacttctaatgcacgttcaccaccaactagcatcaatgaaaatggcaataagcacaatgcaaatgcccagaataaacgattggcacgtaatggttcgcctaccacttttttctgagatgctgccgctaaaatatatgaacccgaatcaaatgttgttgctaagaataagaaagcagatactaagaatagtacaatcatcaatgatgggaatggtaaatgatgcaccacttcaataatggttgcctctgtaccatgtgtatttaaatattgtgttacattaaactgtccagaaatttgtaaatacacagcatagttaccaaaaataccaaagaataatacgcatccaagcgttccataaataattgttcctagcacgacttctttaaggcgtcgaccttttgaaattctagcgataaataaaccgataaatggcgcatatactaaccaccatgaccagtagaatattgtccagtcttgtgggaaattcgtttcttttcgacctttaataccaccgaatggttctaaccatgttgccatatgaaagaaatctctcaacatatttccgaaccctgtcactgtcgtttccataataaaaacagtcggtccaataataaatataaaggctaaaagtacaaaggatagccaaacgttgatatcacttaacttttgaataccttttttcaatcctgtatatgaactaatggcaaatataaccgtgattgttaataaaatggccgaacgtaaaatcatatttttaccatctaaaccagttaatctttctatgcctgcagaaattaatggcacacctaacgctagtgatgttgccgcaccacctagcaatccaaagataaataagatatctacaactttacctacaaatttatctgtttgaccttttaaaatcggacgacaagcttgactaattttatacaccggttgttttttaacaaatactaaataaccaattggtaatgctggtagaacataaatagcccaagcaattggcccccagtggaacataccatattgcgtcgcatattggagtgcttcatcactcatacttttcgcgccatttggtggaacttgatagtaaaaagcccattcaataacgccccagtataaaatatcagagcctatgcctgcacaaaacagcattgccgcccatgtaaatgtattaaattctggtttatcacttgctttaccaagtgtgacattaccatatttaccaaatgcgatatacattacaaagcaaaaaatcgccagccccataaataaatatatcgaaccaattgaatcagaaatggcactattaataccagtgatgatatcttcacttgcttttggaaaagccatcataggtataactgcaaaaagaagtacagctactgtccctataaaggtcgtccagtccataactttctcttttttcaattgtgctccccctaattattaattttatgaatcctgtttcgatttatctcaaaatgtaataattatattgattcacaaaattgacaataactaacatttaataataatgcaaatttcatacaatttgaaacttggcaattattgaatatttatataatttttcccgtaataaacaaaaccttaatagcgctaaaataacagtgttaagttacgatttaacgaatttaacaaattttactagaatggcatttaagaatatttatacgttattaacgaatatttatttattgtaaaacgctaccaaaaagttagacttccttcccactaaaataccacttttctctttcaacttttttaaaaaacggatatgcaacttttagtattggtatcaaaatgattgttaggtcatattctatcaatatatttttataaagaattgcttttattaactttcaattatgtacctaacctaaaaagaagccaaggcaacgaatgttaccttgacttctaatacatattcaactaactatatattcaatcatacgcgcatgcgagagtgattgttgtacatctataatgcgttgatttaaagaacctttatatggtaaatcaggtttgaataagtgttgtataaatagaccatctactaaaacgtcaatgtatgataataactctcgacgttctgtacaatcatttgctaaatattcatataaaaatccagtccatacccaaattgtctttgtatttccaaaacgtgctcgaaatgctttgacaagatttaatgtaatatccaaattacaaaatggttcgccacctaatagacttagcccagatatataatcatgatcgcaatcatctaatatttctgctaatatttcatcagtgtatttctcgccatatctgaacttttgtgaggctttgttataacatccaacacaattaaatggacatcctgatacataaacactgcatcttactccttcaccgtcaacaaagctatttgattctattttagcaatataaccttgtccttgtttaatgtctaaaagtatcattctttaggcgctttcatatgttttactcgtgcgcaaatttctttatgacggcctttaattactggacgttgaactggattgcctaggtaaccacatgttcgtttaacgacatcaactgttttaggattatcattgccacagttcgggcatttaaatcctttttcagttgcttcaaaatctccatcgtaatcacattcataacaatgatc

SEQ ID NO: 49 - DNA, 2258 bp, Staphylococcus aureus
gatctacattatattgctcaaataaaggcgataatactttaggatttggcttctcataggcatccgcttcggtagaaatgatcaaatcgaacaacgaggtagcattggtatgtgctaaaaattgttctacaccttttttagtatcactcgtaacaataccaagttgatagccttttgctttcaaatcgataagtgcttctttaacaccttctacccaattaatttcaggaatacgttcatctaccagcttttgacttgttgacttggaccagtcggttgtatcttgtcccgtcacatcattaaatgcctggataatttgttgtaaagatcctgaacccatcactgattttggatcaatagattctttaatgacaccgagttgtcttaaagcagcttctttattatgtactgggaaagtctcaagcaatgattgtacaaatcgtacccctattttttcccaacttctatcaaattcaattaacgtaccatctttatcaaataatatccattccattgatatcaatactcctatttatttatttcgtattatgctgattctatgatattcgttatcccctgaaaatgaactcgtagtattgttctatttaaatattgaattaaatataataataagtgaaatccccttcaatacttaacaataaacattgtaaacttaatttattaccatgcttcgcttcattgaaagggattttagtcatgattaacttttgcatattgttttcatgattatattcaatttttattaatattttggtacaacgactctccaaccatttttatcttctaaagtaccattttgaataccagtatagacgtcgtataatttttgagtaatttcaccagtctcattattattaataacgatttcacgatcttcgtatctcaatgtacccacaggtgaaataactgctgcagtaccactaccaaatacttctgttaactcacctttatcatatgattcgaataattcatcgattgaaacgcggcgctcttcgacttcatatcctaagtttttagctaattcgataatagatttacgtgtaataccaggtaaaatactgccattcaactctggtgtaattactttgccattttcaacgaagaaaatgttcatgctaccaacttcttcgatatatttctgttcaacaccatcaagccataatacttggtcataacctaatttatttgcattagtttgtgctaataaacttgccgcatagttacctgcaacttttgcaaagcctacaccgccacgaacagcacgcacatattcatcttctacatagattttagttggttttaaagtttcaccaccataatatgcacctgaaggagataaaataattaataatttatactgatgtgatgcaccaacgccaagtgccccttctgttgcaaaaacaaatggacgaatatataatgattgaccttccccttcaggaatccaatctctttcaatatcaactaattgttttagcccctctaacaattctgcttcgtctacttgaggcatttctaatcgtgctaacgagttattaagacgcttaaaattttcttcaggacggaaaagtgcaacttccccatctcttttatatgcttttaatccttcgaataccgattgaccataatgaacaccttgtgcagcaggtgaaatttcaataggaccataaggtactatcttcaaatcatgccatcctttatctgcatcataatcataactcaacatataatcagtaaaatatttaccaaaacctagttgagatgtatttggtttttgttttaatgtttctcgtcgttcaactttaactgcttgtgacatggtgattgcctcctaataatattgtataagaatttgtttaacttaaattataacaatccatattttgctgttcaacaaattttctaaaaattcaaaattaattaacagatttctagaaagactatatcttttagtataaacgtattaatttcacagagacaagtaatctgtgttttactaatatactttacatacaaaaaactctttactttaaaatgaactaagctcgcgaattcaataagtataatgaataatattagaattcatgcactagtttattaaaataaagagtaatttaaaatatcattccgtgtattaaagtgaatggaaatgattagttattatttttaacagtatctttttgttcaatagcttctaacattaatttagtcatgctcgctaaatcatatttaggatc

SEQ ID NO: 50 - DNA, 1862 bp, Staphylococcus aureus
acggactaatatttcaacttccacattaaagacacgtttaatcaacgaataaatacgtcttgccgttgttgcattttccgtttgaacatttataacaaattgttgatttgaaagactaagtgcaccattcattcgaatcagtgcactgagctctgcttttgcattcatttcatcgacgtctattctagttaattcatttttcatttctgatgcaaagctcatcgtacagtcattcctttcttatttaaaacatgattcaccttagaaccactgtctattttcatttttttcacagctctattatcatatcataatatgattacgttctatattatttacgtttatcacttggtacgaaaggaatagtactaattaattctaaagctatgtcataaatcattgtcgataacactttagtattatgtcttactaaatgattttcagaaatttcaactaaatttgaagatgtttttacatttatgctttctttttcaagttcagccttattaacttcaactggtttagaatgtttttcttcatattttttcaaaacttgagcattgaaagtttgtgtactacaaatgacataatcaataaacggttgtccagcttgtctatgaatcgcatcgatatgatctttcacgctataaccatctgtttccccaggttgcgtcatcacattagaaacatatagcttaggcgcatcagaatgaattaacgcatctgaaataccattcacacataagttagaaataacgctcgtatataatgaccctggtccaagaacgattaaatctgcttcccttaaagcatcgattgcttcttccattggttgcacatcgttaggttctaaaaacacacgatcaatttttttatgttttttaggaatatttgtttctccaaaaacaatttctccatcttccataacagcatttaattgcacacttgtatttgtagatggaatgactctacctttaatatttaaaattttacttaatgctttaatggcatgtccgaaatcattcgtaatattagtcatacctgcgattaataaattacctaatgagtgaccgctaatttgattttcttcaaagcgatactgaaaaagttggcttaaaactgactcagaatcacttaaagctgcaatcacatttctgatgtctcctggtgctggtatatccatttcatctctgattttccctgtactcccaccattatcagcaactgttacaatcgccgtaatatcaattgggaattctcttaatcccctagccataactgataagccagtgccaccaccgataagtacaacttttatttgtctcattttttctcgccactttcaatatgtgcgtccctatgatgcacataaacattatattcaaatacttcatttagataattacctagtcgttctgctaatgctacagatcgatgttgtccacccgtacaaccgatggcaattactaattgagatttcccttcttttttatacccgggtatcataaaatctaacaaatcagttaatttttcaaagaaaatctccgtctctttccatttcataacataattataaacgtctttatctaatcctgttaaaggtcttaaatctactacataatatggatttggtaaaaatcgtacatcaaatactaaatctgcatccatctgaatcccatgtttaaaaccgaaacttgtgacattaattgtaaaagtttcaaactcttcatcttcatagtatcgacgaatgcgttcttttaattctttaggtgataactttgtagtatctataacaaaattagctatacttctaatttgagacaaatgctctcgctcatcattaattgcattgattaacgatc

SEQ ID NO: 51 - DNA, 2721 bp, Staphylococcus aureus
gatcaactcattgcaaaatacgatttatagacatcaaagaatcaatacattgtaaaggggatgttgcccatgaaagaagttggatttggcacactaaactgggttgccgttatcatttatctactagctatgttgttcattggcgtttattttaccaagcgcgcgagccaaagtaccaatagtttctttaccgcaagtggtcgcttgccatcttgggtagttggcttttcaatttatgctactacgttaagtgcgattacatttatgtcgacaccagagaaagcatttttaacagattggtcatatatcgctggtaacattgctatcgtcgcaattattccattacttatttatttctatgtccctttctttaaaaagttaaaggtaacatctgcatatgaatatttagaagctagatttggccctagcatacgtgtcattggctcattattatttgtcgtttaccatttagggcgtgttgcaattgttatctacttaccaacattagcaatcacatctgtatcagacatgaacccttatatcgttgcatcactcgttggtttactatgtattttatatacatttttaggtggtttcgaaggtgtggtttggagtgatttcattcaaggcgtcattttattaggcggcgctttagttattattattctaggtgttgtgaacattaaaggcggtttcggcactgtctttgcagatgcgattgagcacaaaaaattaattagtgcagacaattggaaactaaatactgcggcagctgccattccaattattttcctaggaaatattttcaacaacttgtatcaatacacagcgagtcaagacgtcgtgcagcgttatcaagcttctgatagtttaaaagaaacaaataaatcgttatggacaaatggtatcctagctttaatttcagcacccttattttatggtatgggtacaatgctgtattcattttatacacatgaagctgttttaccaaaaggcttcaatacatcatctgtagtgccatatttcattttgactgagatgccaccatttgtagcaggattacttattgcagccattttcgccgctgcacagtctaccatttcatctagtttaaattctatatctgcttgtatttcaatcgacattaagcaacgcttcttcggaaaaggtagcgagcgacacgaagttaactttgcacgtttcattattatcattgcaggtattttcggttttggaatgtcactatacttaattgcttctaattcaaatgacttatgggatttattcttgtttgtgactggattattcggcgttccattggctggtgtatttgcagttggtattttcactaaacgtacgaatacattcggtgttatttgtggattaatattgggtatcatctttgcttatgtctataatggtgttggcaaaggtaactcacctttctatgtatctaccatttcatttacagttgcttttgtctttgcttatatacttagcttcattgtcccttcaaaacataaaaaagatataacgggattaacaatttttgaaaaagataaaccatcaacatacatttcaaaaacggctacgaaaaagtagattgttatgataaaaccccgtcactaagttatgatgcgctgttgcgccaacttggtgacggggtttagctttgccatgaatttaatttaggtacttcgattcatttacaatactaagccaatgattgatcctgaaatgattgaagctagagttgaaccaagtagcaacctcattgcaaaggatgcaactttttctccttgtttatcactaatgcctttaattgaacctacgatgataccaaccgtaccaaaattagcgaagcttactaagtaaactgaaatgataccttgtgttcgagctgatacatcacccaggacatttttaaaatcaagcattgctacaaactcatttgtaattaatttagtcgccattaaagagccagctggaacagcttcgctccatggaatccccattaagaatgcgattggtgcaaacacatagccaataagctgtttaaagttcaaaccaacactaccaaacatgatattaattgcttccattaatgaaataaatgctaacaacattacggctactacaacagcgattttaaacccatccatcgcactatcaccaatcatttggaaaaaggcaactttcttaggttttcctgtttttccattcaatgttttagtttctgtggatttcgttaagttatcaatttcaacatcagtatcatcagatttatagggattgattacactggcgatgataagcgcactaaaaatatttaacattactgctgtaactacgaacttgggttcaatcatctgcatatatgaacctagcattgccatactaacagcactcataccagacgtcgcaattgtatataatttcgctctagataatcttggaataatatcttttattgttaaatatacttctggttgcccaaacattgctgttgaaatagcaaaataactttctaagcgccccattctagttattttattaatagcgatacctacatatttgataataaatggtaataccttaatataattaaagatgcctattaatacagaaataaaaactaatggcagtaatacgtttaaaaagaacgtaaagccatttttattttgtatatctccaaaaacaaaatttatgcctgctttacta

SEQ ID NO: 52 - DNA, 1175 bp, Staphylococcus aureus
tccactctcttcgttgaatccaagattaacgattggcaaacaaattacagaagtaatatttcaacataaacgtgtatctaaatctgaagcaaagtcgatgacaatagacattttagaaaaagtaggtataaaacatgcaactcgacaatttgatgcttatccacatgaactttctggtggtatgcgtcaacgtgtcatgatagcaatggcattgattttaaagccacaaattttaatcgcagatgaaccaacaacggcattagatgccagtacacaaaatcaattactgcagttaatgaagtccctttatgagtacacagaaacatctattatttttatcactcacgatttaggcgctgtgtatcaattttgcgacgatgtgattgtaatgaaagatggaagtgtcgttgaaagtggcacggttgaaagtatttttaaatcgccacaacatacctatacaaaacgcttaatagatgcgattcctgatattcatcaaacgcgtccgccaagaccgttaaacaatgatattttattaaaattcgatcgcgtgagcgtggattacacatcaccgagtggcagcctataccgagcagttaatgatattaacttggctattagaaaaggcgaaacattaggcattgtcggtgaatcagggtcagggaaatcgacattagctaagacggtcgtcggtctaaaggaagtgtcagaaggctttatttggtataacgaattaccattaagtttatttaaagatgatgaattgaaatctttacgacaagagatacaaatgatttttcaagatccattcgcatctattaatccaagatttaaagtcattgatgtgattaaacgaccactaatcattcatgggaaagtcaaagataatgatgacattattaaaactgtcgtatcgttgttagaaaaggttggcctagatcaaactttcttatatcgctatccacacgaattatctggtgggcaacgtcagcgtgtaagtatcgcgagagcacttgctgttgaacctaaagtgattgtttgcgacgaggcagtgtccgctttagacgtttcaattcaaaaagatatcatcgagttattaaaacaattacagttagacttcggcatcacttatttattcatcacacatgacatgggtgttatcaatgaaatatgtgatc

SEQ ID NO: 53 - DNA, 209 bp, Staphylococcus aureus
gatctgaagtagctcgattttaaatagttttcagcaatgacatcgtctttttctgtcggcgtattcggtaccataactacttttgtacctttattaaacacacctttactgtcaaatacgacctcaccaacaccttcatgaattaaagacattggcaatttctgagataagacattctcatcacggctaccagtataatatctttgatc

SEQ ID NO: 54 - DNA, 2901 bp, Staphylococcus aureus; identical to SEQ ID NO: 38

SEQ ID NO: 55 - DNA, 2428 bp, Staphylococcus aureus
gatccaattgaatttttctcatttacaacataatctggatattgaatgttagcagttgtttttgttgtagtattacctatcgtaacattaaactcaacatcgtttttactaacaggaattgtatcagcatccatataaattgaataattaattcccatttgtacagaattaaatcgatcaacataatctgtaaatgtatatgtaattaaattatttgcagtatcatgttttgcagtcgcaattgtttcaccattatttggatctttaatatcaccaatatttttaatatcttccggattcaatccatatacttgtactgtatctgagtatttaattgtgaaataatcacctgatttaactttgtcatcaactgtaatttgtgattttaatgataaataatcttgggctggtacgattttattgtttttatctgcatcaacgacagttaatgttgtatttgatgtgattaaatcattaacatttttagcctctgttgatgatggctgtactgctgctatacgcattcttgtattcaaacgtttaggtgctgtactttttggcaaaatgatatctgcattattttcattatttgaattactattgttatcaacaagagtttcatcattactcttgatagcatcacttttaacatttaatgtagttgattcagttttggcatctacctttttgttttcctcattagttggttgaacatttaccactgatttattctcttgcaaatcaggttgtaacgcttcttgattacttatagtttgtttagtgtttaaatcttcattcgtagattttggtgaagcttgctcatctgatttggcagttgaaacttcaactttatttccagtggtagattgtacactttctttttctattaatttattcccatttgaagtcgtttcattaccttgagatgataccatttctttttgattatcatttttagtattgtcttcttgatttagttgctgcatatcaactttatcactcgattgattatcacttgctgaagttgtcgcttcgttcaattctttattagtactttctgcagcctttgcttcttggttccccagaccaaaaattaatgttgtacctactaaaattgatgctgttcccactgtgtactttctaatcgaaaatttatttaatcgattggataccatgcctttccttgttattgccgttttattttctctgtttagcattagattactcctaattcatcaaatttttaaataatacaattgttttaaatacaaaaatgtatatcaatatagtattacatttttagataaagcacaatactttaattatttttctttatcgtaaaacgttatttaacatttgtgtttaaataaaagtttttatgagttttgtaatctttatttaatcatcataaaaaatagtattatttgcccttgaaattaatatcttagcttttctaattcatagacaattacatttctgtaacaaattaaattgtatctattccttaaagattttttgttttatatctgggaatttctaaacagaaaaaaccaggccacatggacctggttaagttaatcatattatttattttgttttttacgacgaccgaataacaataatgatcctaatgccgcgaataatccaccgaataatgtgccattatttgaattattattttcactacctgtttctggtaatgctttagctgttttatgctgatctttaaccgtactcattggtttagccggagtatgtttacctgcatctgaatctgaatcgctatctgaatctgagtcgttgtctgagtccgaatcgctatctgaatctgagtcgctgtctgaatctgaatcgctatccgagtctgagtcgctatctgagtctgagtcgctatctgaatctgaatcgctgtctgagtctgaatcgctatctgagtctgaatcgctgtccgaatctgagtcgctatctgaatctgaatcgctatctgaatctgagtcgttgtctgagtccgaatcgctatctgaatctgagtcgctatctgagtctgagtcgctatctgaatctgagtcgctgtctgaatctgaatcactgtctgagtctgagtcgctgtctgagtctgaatcgctgtcagaatctgagtcgctatctgagtctgaatctgaatcactgtctgagtccgaatcgctatctgaatctgaatcgctatctgagtctgagtcgctatccgaatctgagtcgctatctgagtctgagtcgctatccgagtctgaatcgctgtctgagtctgagtcgctgtctgaatctgaatcgctatctgagtctgagtcgctgtctgaatcgctgtctgaatctgagtcgctatctgaatctgagtcgctatctgagtctgaatcgctgtcagaatctgagtcgctatctgatgtttctt

SEQ ID NO: 56 - DNA, 1500 bp, Staphylococcus aureus
tctttattcgaactattagattcactttgaccagtagtcgttccatcagatcctttgtcactacctgaagcagaatttttatcatctttacctggtgcattagcacctgctacatcagttggtccattaaatttatatgtaatgttgtaatgatggtcatatttgaatggctttccatttactttttcatcgatataaacgtcaatttttccatctattttaccgttcaacttacttacttcaaattcagaagtgcgttcatctttggcagtgtttttactaataatattttctttatgtccttcgatactcattccagtaatccaatgactgtggttgacagttatttgaacatacaatttaccatttttcttaatgtactttgccggtttattaaaatagtcattagcaattgacgtgtcattggtattgtatttgtaaacctcataattcaaagtaccgctatctgcggcatttgcagaattactgaatgtcgcgatgatgataattaacgctaaaatcgttgtattaaaaacttttaaaatatttttcaaaacataatcctcctttttatgattgcttttaagtctttagtaaaatcataaataataatgattatcattgtcaatatttattttataatcaatttattattgttatacgaaaatagatgtgctagtataattgataaccattatcaattgcaatggttaatcatctcatataacaacacataatttgtatccttaggaggaaaacaacatgacaaaacattatttaaacagtaagtatcaatcagaacaacgttcatcagctatgaaaaagattacaatgggtacagcatctatcattttaggttcccttgtatacataggcgcagacagccaacaagtcaatgcggcaacagaagctacgaacgcaactaataatcaaagcacacaagtttctcaagcaacatcacaaccaattaatttccaagtgcaaaaagatggctcttcagagaagtcacacatggatgactatatgcaacaccctggtaaagtaattaaacaaaataataaatattatttccaaaccgtgttaaacaatgcatcattctggaaagaatacaaattttacaatgcaaacaatcaagaattagcaacaactgttgttaacgataataaaaaagcggatactagaacaatcaatgttgcagttgaacctggatataagagcttaactactaaagtacatattgtcgtgccacaaattaattacaatcatagatatactacgcatttggaatttgaaaaagcaattcctacattagctgacgcagcaaaaccaaacaatgttaaaccggttcaaccaaaaccagctcaacctaaaacacctactgagcaaactaaaccagttcaacctaaagttgaaaaagttaaacctactgtaactacaacaagcaaagttgaagacaatcactctactaaagttgtaagtactgacacaacaaaagatcaa

SEQ ID NO: 57 - DNA, 3174 bp, Staphylococcus aureus
agatcaaactaaaacacaaactgctcatacagttaaaacagcacaaactgctcaagaacaaaataaagttcaaacacctgttaaagatgttgcaacagcgaaatctgaaagcaacaatcaagctgtaagtgataataaatcacaacaaactaacaaagttacaaaacataacgaaacgcctaaacaagcatctaaagctaaagaattaccaaaaactggtttaacttcagttgataactttattagcacagttgccttcgcaacacttgcccttttaggttcattatctttattacttttcaaaagaaaagaatctaaataaatcatcgtcacactcataacttaatatattttttattttaaattttatttaacctatgtcatagatatttcataatctataacataggttattttttttataaaataacgttgcaattaactaacatttcaatgtacaatacaagtaatcaattgataatgattatcagttgataatatacaattaggagttgtttctacaacatgaacaaacagcaaaaagaatttaaatcattttattcaattagaaagtcatcactaggcgttgcatctgtagcaattagtacacttttattattaatgtcaaatggcgaagcacaagcagcagctgaagaaacaggtggtacaaatacagaagcacaaccaaaaactgaagcagttgcaagtccaacaacaacatctgaaaaagctccagaaactaaaccagtagctaatgctgtctcagtatctaataaagaagttgaggcccctacttctgaaacaaaagaagctaaagaagttaaagaagttaaagcccctaaggaaacaaaagaagttaaaccagcagcaaaagccactaacaatacatatcctattttgaatcaggaacttagagaagcgattaaaaaccctgcaataaaagacaaagatcatagcgcaccaaactctcgtccaattgattttgaaatgaaaaagaaagatggaactcaacagttttatcattatgcaagttctgttaaacctgctagagttattttcactgattcaaaaccagaaattgaattaggattacaatcaggtcaattttggagaaaatttgaagtttatgaaggtgacaaaaagttgccaattaaattagtatcatacgatactgttaaagattatgcttacattcgcttctctgtatcaaacggaacaaaagctgttaaaattgttagttcaacacacttcaataacaaagaagaaaaatacgattacacattaatggaattcgcacaaccaatttataacagtgcagataaattcaaaactgaagaagattataaagctgaaaaattattagcgccatataaaaaagcgaaaacactagaaagacaagtttatgaattaaataaaattcaagataaacttcctgaaaaattaaaggctgagtacaagaagaaattagaggatacaaagaaagctttagatgagcaagtgaaatcagctattactgaattccaaaatgtacaaccaacaaatgaaaaaatgactgatttacaagatacaaaatatgttgtttatgaaagtgttgagaataacgaatctatgatggatacttttgttaaacaccctattaaaacaggtatgcttaacggcaaaaaatatatggtcatggaaactactaatgacgattactggaaagatttcatggttgaaggtcaacgtgttagaactataagcaaagatgctaaaaataatactagaacaattattttcccatatgttgaaggtaaaactctatatgatgctatcgttaaagttcacgtaaaaacgattgattatgatggacaataccatgtcagaatcgttgataaagaagcatttacaaaagccaataccgataaatctaacaaaaaagaacaacaagataactcagctaagaaggaagctactccagctacgcctagcaaaccaacaccatcacctgttgaaaaagaatcacaaaaacaagacagccaaaaagatgacaataaacaattaccaagtgttgaaaaagaaaatgacgcatctagtgagtcaggtaaagacaaaacgcctgctacaaaaccaactaaaggtgaagtagaatcaagtagtacaactccaactaaggtagtatctacgactcaaaatgttgcaaaaccaacaactgcttcatcaaaaacaacaaaagatgttgttcaaacttcagcaggttctagcgaagcaaaagatagtgctccattacaaaaagcaaacattaaaaacacaaatgatggacacactcaaagccaaaacaataaaaatacacaagaaaataaagcaaaatcattaccacaaactggtgaagaatcaaataaagatatgacattaccattaatggcattattagctttaagtagcatcgttgcattcgtattacctagaaaacgtaaaaactaataaatcgtctttatatttaattattaaattaacaaattttaattggcggatgaggtatccagttacctcgttcgccaattatttttcgcaatataaaaagtcccacttaaaacaatcattttaagcgggactttttatattgagtaactaaaattatttagctgctacttcttcgccattgtaagaaccacagtttttacatacacggtgtgataatttgtattcgaccacagtttgggcattcagtcatacctggtactgaaattttgaaatgcgtacgacgtttgttttttctagttttagaagttcttctttttggtactgccatgatatatcctccttagattataaacgaaaaatactaaatgttagtttaattaacaacattatatcattaattaaactacttattgctctttatcatataattgttgtaatttttgaagccttggatcaacttgtcgtgattctgaatcatcttgttgcttgctgtttagcaagctcatctaattgatcctcatcgattacttcccaaccattacctactgtcaacatttggtcactttgctctgaataagctctcattggtttctcaataataactatatcctcgacaatatcctgaagattaaccataccatctttaataatgtgatagtgttcatctacatcatcttgatcatcgttatactgattgtacccttctaaatc

SEQ ID NO: 58 - DNA, 2857 bp, Staphylococcus aureus
gatccagcggctgcagcggtaggaaacggtggtgcaccagttgcaattacagcgccatatacgccaacaactgatcctaatgccaataatgcaggacaaaatgcacctaacgaagtgctgtcatttgatgacaatggtattagaccaagtaccaaccgttctgtgccaacagtaaacgttgttaataacttgccgggcttcacactaatcaatggtggcaaagtaggggtgtttagtcatgcaatggtaagaacgagcatgtttgattcaggagataataagaactatcaagcacaaggaaatgtaattgcattaggtcgtatacatggaactgatacgaatgaccatggcgattttaatggtatcgagaaagcattaacagtaaatccgaattctgaattaatctttgaatttaatacaatgactactaaaaacggtcaaggcgcaacaaatgttattatcaaaaatgctgatactaatgatacgattgctgaaaagactgttgaaggcggtccaactttgcgtttatttaaagtacctgataatgtgagaaatctcaaaattcaatttgtacctaaaaatgacgcaataacagatgcgcgtggcatttatcaactaaaagatggttacaaatactatagctttgttgactctatcggacttcattctgggtcacatgtttttgttgaaagacgaacaatggatccaacagcaacaaataataaagagtttactgtaacaacatcattaaagaataatggtaattctggtgcttctctagatacaaatgactttgtatatcaagttcaattacctgaaggtgttgaatatgtgaacaattcattgactaaagattttccaagtaacaattcaggcgttgatgttaatgatatgaatgttacatatgatgcagcaaatcgtgtgataacaattaaaagtactggaggaggtacagcaaactctccggcacgacttatgcctgataaaatactcgatttaagatataaattacgtgtaaataatgtgccgacaccaagaacagtaacatttaacgagacattaacgtataaaacatatacacaagatttcattaattcagctgcagaaagtcatactgtaagtacaaatccatatactatcgatatcatcatgaataaagatgcattacaagccgaagttgacagacgtattcaacaagctgattatacatttgcgtcattagatatctttaatggtctgaaacgacgcgcacaaacgattttagatgaaaatcgtaacaatgtaccattaaataaaagagtttctcaagcatatattgattcattaactaatcaaatgcaacatacgttaattcgaagtgttgatgctgaaaatgcagttaataaaaaagttgaccaaatggaagatttagttaatcaaaatgatgaattgacagatgaagaaaaacaagcagcaatacaagttatcgaggaacataaaaatgaaataattggtaatattggtgaccaaacgactgatgatggcgttactagaatcaaagatcaaggtatacagaccttaagtggggatactgcaacaccggttgttaaaccaaatgctaaaaaagcaatacgtgataaagcaacgaaacaaagggaaattatcaatgcaacaccagatgctactgaagacgagattcaagatgcactaaatcaattagctacggatgaaacagatgctattgataatgttacgaatgctactacaaatgctgacgttgaaacagctaaaaataatggcatcaatactattggagcagttgttcctcaagtaactcataaaaaagctgcaagagatgcaattaaccaagcaacagcaacgaaaagacaacaaataaatagtaatagagaagcaactcaggaagagaaaaatgcagcattgaacgaattaactcaagcaaccaaccatgctttagaacaaatcaatcaagcaacaacaaatgctaatgttgataacgccaaaggagatggtctaaatgccattaatccaattgctcctgtaactgttgttaagcaagctgcaagggatgccgtatcacatgatgcacaacaacatatcgcagagatcaatgctaatcctgatgcgactcaagaagaaagacaagcagcaattgacaaagtgaatgctgctgtaactgcagcaaacacaaacattttaaacgctaataccaatgctgatgttgaacaagtaaagacaaatgcgattcaaggaatacaagcaattacaccagctacaaaagtaaaaacagatgcaaaaaatgccatcgataaaagtgcggaaacgcaacataatacgatatttaataataatgatgcgacgctcgaagaacaacaagcagcacaacaattacttgatcaagctgtagccacagcgaagcaaaatattaatgcagcagatacgaatcaagaagttgcacaagcaaaagatcagggcacacaaaatatagtagtgattcaaccggcaacacaagttaaaacggatactcgcaatgttgtaaatgataaagcgcgagaggcgataacaaatatcaatgctacaactggcgcgactcgagaagagaaacaagaagcgataaatcgtgtcaatacacttaaaaatagagcattaactgatattggtgtgacgtctactactgcgatggtcaatagtattagagacgatgcagtcaatcaaatcggcgcagttcaaccgcatgtaacgaagaaacaaactgctacaggtgtattaaatgatttagcaactgctaaaaagcaagaaattaatcaaaacacaaatgcaacaactgaagaaaagcaagtggctttaaatcaagtggatc

SEQ ID NO: 59 - DNA, 2857 bp, Staphylococcus aureus; identical to SEQ ID NO: 58

SEQ ID NO: 60 - DNA, 1158 bp, Staphylococcus aureus
gatccactgatgctagacgaatcacttgtagacattgagtcgctttctgatgcactgatgctcatagagtcaaattgactattacttgttgagcttgactgcgaatcgctcacacttgttgacgttgattctgatccactcatactttgcgagctactcaatgattttgaatcacttaatgaatccgaagtgctaagacttgtggaaccacttaaagatattgatccacttaatgagtcggagtcacttgtactagtagaatcactcattgatattgaatcacttagcgaggtagactcgcttacgctttctgaaccacttaatgatgttgaggtactcaatgaaccagatgtacttgttgaagtcgaaccacttgttgattttgaatcacttaatgaatcagattcactcacgctttctgaacttcttagtgacgtcgatacacttaatgatgacgaatcgcttgtgcttactgaatcgctcatcgattgtgagcaactcaatgaacttgactcgcttacactttctgattttcttaatgacgttgagacgctcaatgagccagaatcactgacacttgttgagccactcatcgatttagagtcactttcagaattagattcacttacactttctgaatcatttacagattctgacatactttgtgaatcagatatgcttgcgctcattacttcactagccgatgttgatgtacttgtcgaatcacttaacgatatagacacactcatcgaaccagatgtactcgcacttgttgagtctgatgttgaatcactaacactatcagataatgacgttgaatcactcatacttgttgatgtacttgtcgaaagcgacatactttgtgaatcactagtacttgtacgcatcgaagtactagttgaagctgatgtactacgagagtcacttgttgatgttgatgtacttgctgatcctgatgcacttgtacttcttgatgtgctttgtgaatcgcttaatgatgttgatgttgaatcggattcacttgtactttctgatgttgagccagactctgatgtacttaccgatgtagataaacttgcaatggtcgacatgcggtttgaagttgatgtacttagcgaatcacttaatgatgctgatgtgctttgtgaatcggattca

SEQ ID NO: 61 - DNA, 2084 bp, Staphylococcus aureus
caggattcgttttatctaactcttccccaaaagctgataagtgttgtgtagtttgtgttgtcattacagtaactaagattgctgtacctatagagcctgctaattgacgcatcgtatttaagaaagcattaccatgagaggcaagtcgtcccggtaacgcattaatagctgcagttaccattggcatcattataaatgccataccaaatgaacgaagtacatagatacccatgattgtcatatatggtgtatccatatttaatttagttaattcccatgttgcataagtcattacagcaataccaaagatagctaatggttttaaaccaatagtatctaacaatttacctgcaaatggtcctagtagacccataattagagaaccaggtaataataacaatccggaatctaatgctgagaatccgcgtaaattttgtaaataaatcggtaataaaatcataccaccatataaacttaacattacaaccatattaataattgttgttaatgtaaatgttgggaatttcaatacttctaaattcaacattggtgatttcattcttaattctctaataacgaatagaataataaagataataccaatcgcaaacattgtttctatctctactgaaccccaacctttgttgccagcttctgagaaaccatataacaaagcaccaaaaccaatcgtactaaaaatgatacctgggatatcagctttagggtttgttgtatattgatataacttaaaccatacaaaaccaattaaaatagcgataatcccgataatgaacataccgtaaaacatcacattccaatggtaattttgtacaatataacctgataatgttggaccaattgcaggtgctaaaatcattgcgatacccattgtacccatggcagcaccacgtttttcaggtggataaattgtaataataacaattgaacctaatggcattagtacacctgcaccaatggcttgtaatacacgtccaaccatcatgattgggaaattcattgaaatcgcacagattaatgaaccaattgtaaagagtactaacgcaactaaaaataattttcgatatgaatatttattaaatagatacgccgtaattggtattaaaataccgtttactaacatgaatcccgtcatcaaccattgccctgttgacgcagaaatattaaattccgtattaatttttggtaaagcaacatttaataatgtttggtttaaaatcgcaataaacataccgaataataatgccgctaatattttaccgcgtgaaacaccttcaccaaaaataaagtttttatgttctttttttattttttcattcactttatattcttctgattcaggatttttagcagcaactgcttcctcatccttattattagtgaatgcttcttgatctttctcagacccctttgtgtaaccatttagactaacttggctatgatcatcttgattgtcaacacgcaactcttcatgcgtcatacgttgtgtcgattgatcagttgttttgtctaaatcactagctttaaatttagattgatttgattgacgtgtcgtaaattgttgttccttttgttggcgtttgcctttttttcttgatcttattaaaaataaattgataaccccaacaataatgagcgctaaaataatgtagctaataatgaaggtcgtagtcatttaatgacccccttaatttttatggatttttacttcagcgttcattccaggaacaacttgtttagacggttctgattctagagtgattttaacaggtattacttgagaaactttagtgtagttaccatcactatttgatgatggcattaatgaaaagcttgcagcagttgcttttccaatactatcaactttacctttaatagaagctttttgaccgtcaatagtcacatcaacatctttacctacttcaacatctttaatatctttttcgtcaatatttgctgttacatataaatcatctaaattgtatgcataagcgattgggttaccagcttgcaccattgaaccttccataccatctaatttggcaattgtacctttttgaggcatt

SEQ ID NO: 62 - DNA, 2571 bp, Staphylococcus aureus
catacttctatgtctggttcttgatttaatagctcataaatatcaaatgctggtgattctcttatatcatcaacatcacctttataagttaaaccaaatactgtgactttattcccgctcaacactttgatgatttgcttcgttgtatcaacaacataggccggcattgaattattaatttcacgtccagtttgaattaactttgcattttcagggtctttagcaataataaagtacggatcaacagctaaacaatgaccgcctacacctggaccaggctgatggatgttaacacgcggatgtttgtttgccatttcaatcacatctaatacattaatatttaagttattgcaaatttttgttaattcattagctaaagcaatgttcacgtctctatatgtgttttccattagcttactcatttcagcagtacgtgcatctgtttcaatcatttctccctgaacgaatgtgcgatagacacgtttacccgcttcaatacaagcttcagtcacaccgccaatgatacgattgttatgaactaattcttctaaaatttttcctggcagtacacgttctggacaatgcactaaataaatatcttcacctattgtaaaccctaaattttcaatgactggttttacaaaatcatccatcgttttaggcgcaattgtcgactctacaataatggtatttcctttttctaaaaatgataaaatactatctaatgcacgcataactagcgaaatgtcacatgaccggtactgatcatcattattcggcgtcggaacggcaatgataaaaacatcagatgcatctggcgttgtagataccttcaattttcccgatgacagtacctcttcataaacctcttgtaatccaggttcttcaatactaatttgaccactttgtaacttatcaatcgtttgctgattaatatcaacaccaagcacatcgacgccatgttttgcaaacataattgatgttggtaaaccaatataacctaagccaactactgttaacttcatactataacctccaaataaaacgatttgtatgttgattttatttaatagatgacttatgccttatctttggttgtcgtttcatccatgatgtccgcaataacaagtgacatttttccaggaataatttcaagtgcattattattttcatataacgtattgctgtatattaaattgccgaataattttctaaagaccgacaacttattaaaatacttatttagcattgaaggcatgttgatcaataccgttttacgatgtgattggcgacgtatttcatacattactgacgatgtatcaaagtaaaaactatcttgaggatggtacacacctgtcacttctaatgatattaattgatcaataaatgctgtcagatgtttaatatataatgcactgcgctgattgttaatattgggaatgattggcaatcgctttgacaattgcattaaccgttggaaatttcctgggcaatgtgcaccataaatcattggtggtctcacaattgctactttaaacgaatcactaatcaattcttgtaatgcttgttcagcgaactttttggaaataccatagttggtcgtagggttcattggtgtttgtgtatcaacttgatctgatttaccaacatgaccttcttttccataaactgccatagtactcataaaaataaattgtttaacgtcttcagctttagccttttgtgccaattgtttcgtcagcaacatattcacttgcatataatcagatagccttgcttgaggtgaattgttgtgaaccaaagctgctgtatgaattaaaacatcataatctttgaacgaggtcgacttccataattgattcctaacattaatttgatctacttgatgtccttgttcaataagcttatcttttaaagcattaccgatatatccatgtacgcctgtaattaaaatattttttctcattagtgatgcacaccttctgaagtaacgatatttttaattgttttatatatgatatacatatcaagcatcatagattgatgtgttaagtaataatgatcatacgctactttttgatcatcagtgatatcatctctccccatcacttgagctagtcctgtcacacctggtctaatcgtatgcacgttcgcttttgtacgtttttcgattaattcgtattgattataaagcgctggtctaggacctacaattgacatttctccttttaaaacattcaataattgtggcaattcatcaatagaggtcttacgaatgaccttccctgtctttgttatatacgatgttgaatccattaaatcagttgcaacattaggtgtgtctattttcattgatctaaacttataaatattaaacaattcattattaatcgtcggtcttttttgtttgaaaatggctggtccaggtgattccattttaattagtaatgctgtaattaacagaatcggacttaaaactactaaaccatatattgaactcactacatcgaataatcgcttcataattatctcctcacttcaacagattgtaatacttcatagtattaattt

SEQ ID NO: 63 - DNA, 2274 bp, Staphylococcus aureus
cagtaattaataaaattttgtcatcgaacataattatctccctttttgccattggcatagttaataattttttctttactaaagtcattgacgatgtcttgaataatcgcttcaacttcattacatttcatatgttgtactttgccacgataaattttttcaaatacttgttcaggatgaacctcatctttattcataagctcttcaaacattttttcgccgggtctaatccctgtataagtaatgcgtatgtcgtcttcttttttaccacttagcttaattaaattacgtgccaaatctacaattttcactggttctcccatatctagcacaaatacttcgccaccttctgctaatgcccctgcctgcaaaactagtctagaagcttcaggaattgtcataaagtaacgtgtcatttcaggatgtgtcacagtaactggcccaccttcttcaatttgacttttgaaaagtggaatcacagatcctctcgatccaagtacattaccaaatctcactgcaacaaaatttgttcgatgcgtttcatcatttaaactttgaataatcatttctgcaattcgctttgaagctcccatgacattaggcggattaacggctttatccgtagaaatcataacgaatttctttacctctgcatttttagcagcttcagcagtatttttcgtacctaaaatattattacgtactgcttcttcagggttgtcttccattaacggcacgtgcttgtgtgctgctgcatgataaactgcgtatggtttatacgtttccataatttcaaacatacgcgctctattttgcacatccgctataataggaacgatatcaacattttttccgaagcgatttcgcaattcacgattgattaaataaatactgttttcaccatggccaagtagaataatacgttctggatagaaattacaaacttgtctacaaatttctgatcctattgaaccacctgcacccgtaactaaaatagttttattcgtcaattcatttgatatcatatccatatctaattcaacaggatctctgcctagtaaatcttctacttcaacttttttaagttggttcacttctaactcaccagacatgacgtcttctatatttggcattttcaataactcaacgccatccatatggcaaatattattaatttctttcaaacgctcttgaccaatagttggaattgcaatgatgatttttttaatcttatatttcctcactagttctggaatatccgcaattttaccttggacttttacaccctcagtaattgtgatattgcgtttatgttcgtcatcatcgactgctaataccggttcaagtttcatttcgtcacttttcaacatttgtctaatcagcattgaacctgcttgaccagcaccaacaactaaagttggcttcttattaaatgacttacctccaaggtatttccgataaatacgccaaaataaccttgagccacctattaaaatcaagtgcatcatccaagtaattaaatacaatctaaaaaacggtctattgcctgtaacaattgtcacgaccaccatcgtaataacgatagatgtcgtcacagctttaacaattaaaatcaattcactcacactggcatattcccacgctcgatgatacatattaaaaataaatgctgaaatatgatgcgatatgaatagtgatatagctgccaatattaataatttgacagaatatgttttgaaatacggttctaaaatgtaataacttacgaatactgaaaatgtcactatcagtgaatcgattaatgctagtattaaaagccgcaatttcacagataaatgtgccataaaacccctcatttgctgtttataacccaaaccatcttttctgtttataatcttgttgtggcattcgtttaggaatttttttatcatcaacaactaacttcgcattactaataaatccgttcatatcttcataataatcacgtaatttcttatcattaaataagtctttcattaagaacggtctgatttctgtgttatgcgcatctgaaccgatgaaatgtgtcagattgttttcaatcatttgaattgctaattttctaatttttttaccggaaatacccgctaatgacgccgttgtcacttgacttaaagcacctttgttaattaaatcgtatagtatgtcaaggttttgacttattgctttattccgctctggatgtgcaataatcggtacaaagcctttactctgtaattcgaaaaataattgatc

SEQ ID NO: 64 - DNA, 233 bp, Staphylococcus aureus
atcaaaaagttatgatgaacgttttacgccggatgaagtagtcgcataccaacaacatcaaggtaataaatttaaagaacattttgatttgaattgttatctgacactgctagatgtattggatagtcacaacattgaccgaggtcgcacagacgtaacgcatgtttttaaaaatttagaaacaaaagtgttaacgatggggttcatagatgatttgctatatccggatgatc

SEQ ID NO: 65 - DNA, 3052 bp, Staphylococcus aureus
aacatacaggtaaagttttacttgtaactgaagataatttagaaggtagtattatgtcagaagtgtcagcgattattgcagagcattgcttgttcgatttagatgcaccaatcatgcgtttagctgctccagatgtaccatctatgccattttctcctgtattagaaaatgaaattatgatgaatccagaaaaaatcttaaataaaatgcgtgaattagcagaattctagggagggaaagtcatggaaataacaatgcctaagttaggtgagagtgttcatgaaggcaccattgaacaatggttagtttctgttggtgatcatattgatgaatatgaaccattatgtgaagttattacagataaagtgacagctgaagtcccttccacgatatcaggaacaattacagaaattttagttgaagcggggcagacagtagctattgatacaattatctgtaaaattgaaactgctgatgaaaagacaaatgaaacaactgaagagatacaagcaaaagtggatgagcatactcagaaatctactaaaaaagctagtgcaacagtggaacagacatctactgctaaacaaaatcaaccacgtaataatggtcgcttttcacctgttgtatttaaactcgcttcagagcatgacattgatttatcacaagttgtaggtagtggatttgaaggtcgtgtaactaagaaggatataatgtcagttattgaaaatggtggtaccacagctcaatctgacaaacaagttcaaacaaaatcaacatcagtagatacatcaagtaaccaatcatctgaagacaatagtgaaaacagcacaataccagtaaatggtgtgcgtaaagcaattgcgcaaaatatggttaatagtgtaacagagattccacatgcatggatgatgattgaagtagatgctacaaatcttgtgaatacgagaaatcattataaaaacagctttaaaaataaagaaggatataatctaacgttctttgctttctttgtaaaagctgtagcagatgctttaaaagcatatcctttattaaatagtagctggcaaggaaatgaaattgtcttacataaagacattaatatttcaattgctgttgctgatgaaaataaattatacgtacctgtgattaagcatgcagacgaaaagtcaatcaaaggtatagctagagaaattaatactttagcaacgaaagcgcgtaataagcaattgacagctgaagatatgcagggcggtacatttacggtaaataatactggtacatttggttcagtatcatcaatgggtattataaatcatccacaagcagcgattttacaagtagaatcaatcgttaaaaagccagtagtaattaatgatatgattgcaattcgtaacatggttaatttatgtatttcaattgatcatcgtattttagatggtttacaaacaggtaaatttatgaatcatattaaacagcgtatcgaacagtatactttagaaaatacaaatatatattagtgataacatagatgcatctatcgacaacttgttttatcttgttcttgtcgatggatgtattattttttggcactaaaatatgtgcaatatattcaaaaaagataaagaacaataatcaacatggttgaatgcatttttgcagtaaagtcaaaataagacatcatacttgaaacatattaatgaaaacatgtgaacaaattagttaccatgattttaagcacaataatgtttggtatattgttaaaattgtgtctaaatataggtgtgattcagattagtttattgaacaatatgttattaattagtagaatgaggatagtttaaatataaagggataggtgattgaacttatggacatgaatttcgatttatacatgaacggtgttgtagaacaagcaaggaatgaaattgaatctgcgggatatgagcaattaactactgcagaagatgttgacaaagttcttaaacaagatggtacaacactagttatgatcaattctgtatgtggttgtgcaggtggtatcgcaagaccagcagcatcacatgctttacattatgacgtattacctgatcgtctagtgacagtatttgctggacaagataaagaagcgacacaaagagcgcgtgaatacttcgaaggttatgcgccttcaagtccgtcatttgcattagtaaaagatggaaagattacagaaatgattgaaagacatcaaatcgaaggtcatgatgtgatgaacgtaattaatcaattacaaacattattcaataaatattgtgaagaaagataagaggcgctaacccatgttaaagttaaatccttacaagattggatttagaacaataaaaacagcagtgggtatgactttaggtgtaattattagtaagctgttaggtttagataattatgcttcaagcgccatattagtcgtattatgtattaaacatacaaaagtacattcgctacaagcgattatttcaagattagtatcatgttttttagtattgtttttaggttcagcaatatttagtttattaggtcagagtccaattgtactcggtattatcgtattgttatttataccattaactgtcgtattaaaagtacaagaaggtgtcattacgagttgcgttatattacttcatgtttttaatgcaaaatcaattgatgcacatttaattgttaatgaaacattattactgttaattggactaagcattgcatttacaatgaatttaatgatgccaagtttagacaaacaactagacgaatacaaatgtaaaattgagcaacaaattgctgatatttttagtaaatatagttatatttgtgaaaaatatgaagataccattgcgattgaatttgaagtgttacttttaaatattaaaaaggcgaagtctatcgcgttccgagatgttaaaaatcattttgttagaaacgaaaattcatactatcattattttgatatgcgagaagagcaagtggaattgttaatgagaatgaaaccgctcatcgaaagtatctgtcataaagatcc

SEQ ID NO: 66 - DNA, 1468 bp, Staphylococcus aureus
gatcttcgcgtcttaatggatgccatatacgaactgaatgaccaccaagatttgcgtgagattactaaagattcgaaaatgcaaaaactcgcattagcaggattccttaaaaagataaaaggtacgtacattgagtcattattaaaagaacacaaattgttataacgaaaaccattaatagatttttatttggtgatttcaaatcatgagactgggacagaaatgatgttttcataaaaattatttcgttgttccactctcatgatttttttgatgaaacataattacatgattgattgcatcattttgttaaacaagtgattgcaaacctgccatttcacactgaaaatttacataataagtgacgatattttacaagtcatatacaaataacatatattgttaaataattttacctaatcttaacattaaatttacaattataagcgataatctaaatataaagcttatttgaggtgaaataatggaaatgtcggttacagaagtcattttctcctttttaggtggtttaggtattttcctttacggcttaaaaatcatgggagacgggcttcaagcatcagcaggagacaggctacgagatattttaaacaaatttacatcaaatccagtattaggtgttattgcaggtatcgttgtaactattttaatacaaagtagttcaggtacgacagttatcacaatcggactggtaacagctggatttatgacattgaaacaagccattggagtgataatgggtgctaatatcggaacaacggtaactgcatttattatcggtatagatttaggcgaatatgcaatgccaattttagcattaggtgcattcttaatctttttctttaaacgctctaaaatcaataacattggccgcatactattcggtttcggttcactattcttcggtctagaatttatgggtgatgccgttaaacctttagcatcattagatggatttaagcaattaatgcttgatatgtctacaaatccaatactcgctgtcattgtcggcgcagggttaacagcactagttcaaagttcaagtgcgacgattggtattttacaagaattttatcaacaagatttaattagcttaaacgcagcaatccctgtgttactaggcgataacattggtaccacgattacagctatcttagctagtttagccggctcaatcgctgcaaaacgtgcggcgcttgtacacgtcatctttaacttaatcggggtaattatcttcacaattttcttgccagttgtgattcatttgattagtttgttacaagatttatggcacttaaaaccagcgatgacgattgcagtatcacatggtatcttcaacataacaaatactttgattcaattaccatttgtagcaggtttagcatggattgttacaaagcttgtcccaggtaaagatattgctgatgactataaacctcagcactta

SEQ ID NO: 67 - DNA, 711 bp, Staphylococcus aureus
gatccaaaatcacttgtttgattggtttattcttattagactgttgatgaattcgatttaaataatacgtcaatgcttcatttgaaaaaggttcaggcgctatttctaaaaatgaaggataagatgctacagacgcaacatttctaatttctccaaaacgacgtatatctgaataaattaactttttgtcatttgacaactcaaaaataacatgccaatgcttacgataattaggtatcataatatcttcaagttcatctacaatgaaaaaaccgcccgccatacctaaatgactaattaatgtacgttgttctcgtttattatctagctgaaaaacgatatatttacttcttcgttctacatttgtaatggtatagccttccgataaagttttaaaagtatctaattcaattccttttataattgtttccttgccttgagctttaccttcgattactttatccgaaaatataacgtgttcaattttttgatttataacgtagggttcaattcctctttttacatgttctacttctggtaattcgggcataccattaacctcactttattttgcatcataccaggttgcaccataacttgagtctacttttaatggaacatctaattgcaatgcattttccattatctcttctacaaattcactaaatgaatctacttctgacttaggtacttcaaaaattaattcatcgt

SEQ ID NO: 68 - DNA, 2311 bp, Staphylococcus aureus
cttgtaattcttgttggttaaaatatggatgtacctcaatttgattcaccattggtttgatacttgattgagccattaatttttctagatgatgaacattaaaattacatacacctattgcttttaccttaccttgctcgtaaagttcttccatagctttatatgtttctaaaaatagaccatctgcttcacaaggccaatgtattagaaataaatcaagataatcagtttgtaaattttcaatcgatttgttgaaatattcgaatgttttctcataaccttgatagtcattccataacttcgttgttataaacaaatcttctctatcgacgccattatcctttaatgctcgtcctagtgaagcctcattatcataaaagtatgctgtatcaaacgctctatagcctgcgtcaattgcagcatttacaactttagtcatatcttcgtcagagattttataaacacctaacccaactgaaggcatcgggtatccattatttaatatttgtatctcattcaacatctttatatctctccaatctatgtatcttttatatctttacattaccctaaatttttcaacaaactcaattaatacgaattatcgctttcaataaaaattattcattaaatcattaaagatattgagttccaatactattttcacttttcattaattttagtcaaaaaaataaccaaccaaaaatgaattaaatcattcttagttggtttatatattaatatctattctgatttttcatcttcatcagactgtccgatagtaggtctcgcttcattaaattcatagtttaatatcacccaaataatttggtggttatcgatttctgaaacaacccagcgatcataagttgtatccacgtaatcatctttttgtaaattggtattacgagattgtaaccatccacctatcgtatcaatatcctcagagtcatcaaattctataccgaactcttcagttaaatcatccaatagtactctgccatttacttggaatgtcttattatcaattttaacgatatcattcacttcatcatcatcaaattcatcacgaatttctccaacgatttcttctaaaatatcttccatcgttaaaatacctgccgttccaccatattcatctataataagactcatatgtacatgttcacgttgcattctaattaatgcatcactgatacgtgttgtctctgaaatcattggcaactcatgtatatagtttgctattttaatcgtttttccagaagcgtattcagttaaaaattctttgacgttaataaatcctttaatgtggtctttatcaccatcatcagtaattggataacgcgtaaattgatgttcttttattgtttctagtaattcgtctacattaaaaggttcatttagtgtaatcatttgagttctaggtaccattatatcttttgcatgtctttcatcgaatgaaaagatattttgcatatatgccaattcagtttggttgatttctccaccattataactattgttaataataattttgatttcttcttctgacattgcatcagtttgggcatcaggatttacaccaaacattctaataataacacgtgcagaaccattcatcagccaaatcaatggtttcataatgttaccgaaatagaacaatggtcttgcatatactaaagcaagcttttcagtatgttgaatagctatagatttaggcgctaattcaccaagtactacatgcaaatacgtaacgattataaatgacactgcaaacgaaatcgtcgtcgttaatgcagttggtaaattgattgcttcaaatattgggtgtaatagcttttcaaacgttggttcaccaagccaacctaaccctaaagatgttactgttatacctaactgacaagcagaaagataataatctagattagcaatcatcttttttactattttagcaggtttatttccttcatctgctagctgttcaattcttgttgctctaatttttactaatgcaaattctgaaccaacaaatacagtggttaatgcaattaatagaataaatataatcaaactaattatggtcgaagtttccaattaattccctatttctagggattcacctccatgttatatgtgtcactcatgggtaacacgcattcaaatttatcactatgacttaaattacaactacatgttatcgccttcccatttagacacccccagaaaaaaatgttattgcttctattttatcataatataaagtgcttatgttaacagattaaatctattgcatacatttaattatgattat

SEQ ID NO: 69 - DNA, 2426 bp, Staphylococcus aureus
tcttctgagaaggtttttgacccatttgcatcatcatcatacgaagcatttcttcgttgattggtgggtttttcttcaagtagtccatcatatattttctagctaaaaggaaacctccaattaaacctaaaattaatgcagctactataaaaataattgctacccaagttgccattgtttcacccgctttctttatcctactgaattttgctaaattcatcacattatttcaagaactagtttattcaagtattttaatatcgatactaaaaataatatcaaaaatcatgctgttataacagagcttttaaagattaatctgaaatagtatactttcataacttatcacttatgatgtagtttaagtgctatactctaaatttcaacactttaaaaaaagcctaagattatgcatcctagacttctaaacatactcgctttataaattattcttataagctcataacttggtttaagatattttcttttgtaaatccatatttttcaactactaaatcgccaggtgcacttgcgccaaagccgtcaatagcaataactttacctgcagtacctacatatttatgccatccaagcggtgaagccatttcaatcgcaacacgttttgttacgcttgatggaataactgattctttatattcttcagattgttgttcaaatgcattccagttaggcattgaaacaacacgtactgatttaccttgtttttcaagatctttagcagcttcaactgcaagactaacttctgaacctgaagctaataataggaattctggtgtctcttcagagccataaactgtataggcaccttttcgaacgccttcttcaactacatcttctggtacatctaataccggtaagttttgacgtgtcaatactaatgaagtaggtgtagattcagattctaaggcaacttcccatgctactcttgtttcattaccatcagcaggacggataacattcatatttggaatggctcttaatccagctaattgctcaattggttcatgagtaggaccatcttcacctactgcaattgaatcatgtgtgaagatgaacgttgcatttaatcccataattgatgataaacgtaacgctggttttaaataatcactaaatacgaagaatgttgcaccatatggatgtaaacctccatgtgcagccataccatttacagcagcacccatagcaaattcacgtacaccaaaccacacatttttaccttcaggtgtttcagaactataatcagttgcatcatttacattggatttgtttgaaccagcaaggtctgctgatccaccaaagaatgaagggacagttttactgattgcttgaataacagtaccagaatcagcacgagatgcaccattatgacccagttcaaaacgtggtaattcatccttataatttttaggcaatttaccactaatcgctaatttaaattcttctgctaattcaggatatgtttctgcatatttttctaataatgaattccattgagattcatcttcattagcacgttttaacatagtattttggaaaatttcgtatacctcttctgaaacattaaaacgtttttcaggatctaaaccgtaattttcgaatgttaattttctttcaacttcacctaaaggtgccccatgaacaccattagttcctgctttattcggtgaaccaaatccgattgttgttttaacttcaataatcgttggtccttcttgagatttagctgtagtaatcgctttatcaatttcttctaaatcattaccatctttaactagtaagtaattccaaccatatgcttcaaaacgagcttttgtgttttcagaaaaagctttgtttaattcgccatctaatgaaatatcatttgaatcgtataaaacaactaatttacttaatttattatgtccagcaaatgaagctgcttcatgcgatataccttccattaaatcaccgtcagaagctaatacatatgtgtaatgatctacaacattatatccttctttattaaatttccctgctaggtgatcttctgctaaagctaatcctactgacatagcaaaaccttgtccaagtggtccggtagtaacttctacaccatctgtatgtctgtattcaggatgacctggtgttttagaaccccattgtctaaattgctttaattcttctaattctaaactaccagaaacatgtaacaagctatacaataatgctgaaccatgccctgcagataatacgaaacggtctctattgaagtaatctttagattgtggattaaaattcagatgacgtgtccacaaagtgtaagccattggggcagctcccataggtaatcctggatgaccagaattcgctttttcgattgtgtcgatacttagtgcacgtagcgtatcaacagctaattgatc

SEQ ID NO: 70 - DNA, 1067 bp, Staphylococcus aureus
gatctaggtatggataaagacgaagccaaaaagttattcgccaaatctgaaagtattttcaaagaccttaaaggcgtaaaatacaaagtagactataaagataaaaaagcaattgaacacttagacatagattacacagaagttgacatgaaaaaattaaataaacgtcttggtgtttcgactaaagaaaataaagatattagttttgaaaaacttgaaaagcaattaaagcacagaggtttaaaagaaaaagataaaatggacgacaaatagtttataacttaaaaatgccctcagataagactaaggttacaaaccttaattcatattctgagggctttaatatttgaagttcttgtgtgaccagcatccactactaatataaaattatttgcagtaacgctaaaatccgctgctttcaatttcccgaaataattaagttaactaatgagttttaatttataatcatgtatcgtttgtaactcaccatcgacttttcgatatacaatatgatcagcagtaatttctgtaggactggatacgccaacagctgctgcaatattgaataagccttcatgcaaacttgttacatagtttgtgacacgatattgcttttctccaacaatcaatgctttttctttcttcgcatctgtcgttgcaacacctacaggacacgtattcatgtgacattgttgactcattatacaaccgacactaatcatcatcccacgtgcgatatttacaaaatctgcacctaaacctagtgcaatcgcaattttatctggtgtcactaacttaccagatgccgccaatttcactttatctcgaataccatatttttctaacatgccagacacaataggtagagctgtaaatagcggtaagccaacaccatcttgtaattcttggaatgttgcaccagtaccaccttcaccaccatcaatcgtaataaagcttggatacttatctagttccaccatcgtacgtacaagtgtttcaatttctgaaactttgcttactacaattttgaatcctactggtttttgacctaattgctgcaactgatc

SEQ ID NO: 71 - DNA, 2327 bp, Staphylococcus aureus
aggtatggataaagacgaagccaaaaagttattcgccaaatctgaaagtattttcaaagaccttaaaggcgtaaaatacaaagtagactataaagataaaaaagcaattgaacacttagacatagattacacagaagttgacatgaaaaaattaaataaacgtcttggtgtttcgactaaagaaaataaagatattagttttgaaaaacttgaaaagcaattaaagcacagaggtttaaaagaaaaagataaaatggacgacaaatagtttataacttaaaaatgccctcagataagactaaggttacaaaccttaattcatattctgagggctttaatatttgaagttcttgtgtgaccagcatccactactaatataaaattatttgcagtaacgctaaaatccgctgctttcaatttcccgaaataattaagttaactaatgagttttaatttataatcatgtatcgtttgtaactcaccatcgacttttcgatatacaatatgatcagcagtaatttctgtaggactggatacgccaacagctgctgcaatattgaataagccttcatgcaaacttgttacatagtttgtgacacgatattgcttttctccaacaatcaatgctttttctttcttcgcatctgtcgttgcaacacctacaggacacgtattcatgtgacattgttgactcattatacaaccgacactaatcatcatcccacgtgcgatatttacaaaatctgcacctaaacctagtgcaatcgcaattttatctggtgtcactaacttaccagatgccgccaatttcactttatctcgaataccatatttttctaacatgccagacacaataggtagagctgtaaatagcggtaagccaacaccatcttgtaattcttggaatgttgcaccagtaccaccttcaccaccatcaatcgtaataaagcttggatacttatctagttccaccatcgtacgtacaagtgtttcaatttctgaaactttgcttactacaattttgaatcctactggtttttgacctaattgctgcaactgatcgacgaaacgaatcaaatcttcagcattatgaataaattcgtaacggttaggtgaattgattgttttataaggttcaacatttcggattttagcaatttcttcgtttaccttttcagcttccatatgaccaccacgagtcttagcaccttgtgccaacttcagctcaaatgcgcgtacgttagataactgtgcaacctctttaaataaaccttcactaaaattaccttctttatcacgaacaccaaataaaccgggaccaatttggaaaatgatatccccattaccttttaaatgatattctgataagccaccttcacctgtattcatccaagtgcccgctttagctagacctttagataaagctgtaatggcattttttcctaaagcgccataactcataccagattgtcctacgatacgttttaaaataaatggatgttttaaatgttcacctaattttattgcatggtcatcacttaagtaatacggatcaatctttgtcggcacacgatattcttcacgactaaataaacgctcattcgcgattttataaatgaatgttgataacaatgttgtattatctactgaaatctcattacgttgcatcggaaacattgtgttctgtatgtaaaagccgtcttgataatctttagtagtaccgaagctggtcatacgagagttatattttccagccaaaacgatatttttataatcattacgtgaaaaaggtttcccttcattatccccagaaaataaatactgacgtaattccggtcccattttttctgaaatatatctaatacgtgctagtaaaggataattccttaatacactatgttgtgattgtcttttatctttaattaaccaaataagcccgataacaataaccgtaagcatgaatcctacaacgataatgttaactataaattgcatgactgtaagaaacgtcattacaatacctccccccaaaatttcaattcaatatttatgatacaccttacaaaacaaaacacaatggaagcgcttcattttataaaacaattttatgatatgtttttcattttaaattttaatgtataaaacatacaatacaaagtaatatgtgctaaagtatctatataatacaactatttaagaggtatactatgtcaaatacaaataaacattacatagaagaagaatacgctaccgaacaatcgcgttttttcaaacgtgatattggatttattttcctttacatatttttggttaacatcttgccgatc

SEQ ID NO: 72 - DNA, 1352 bp, Staphylococcus aureus
gatccttttgttgtagacgtaatacgttcttgtaattgtcccatttcagtagcaagtgttggttggtaacctactgcagaaggcatacgacctaataatgcagatacctcagaaccagcttgtgtaaatctgaaaatgttatcgatgaataataatacgtcttgaccttgttcgtcacggaaatattcagccattgttaaaccagataatgcaacacgcatacgtgcaccaggtggctcattcatttgcccgaataccatggctgttttcttaattacaccactgtcactcatttcgaagtataaatcgttaccttcacgagtacgttcacctacaccggcgaatacagaaataccaccgtgctcttgagcgatgttgttaattaattcttggattaatactgttttacctacaccggcaccaccgaacaatccgattttaccacctttaatataaggtgctagtaaatctactactttaatacctgtttctaaaatttgaacttctgttgaaagttcatcgaatgctggtgcttgacgatggataggatcgcggcgaacagaatcactaatttcttctttaaggtcaattgtttcacctagtacattaaatacacgacctaatgtttcgtcaccaacaggtacactaatttctttgcctgtatcttttacatccatgcctctttggacaccatcagttgaatccatcgcaattgtacgaacaacgtcgtcacctaattgcagcgcaacttctaatgttagttgtattgtaccttcttctttaggcacatcaataaccaaggcgttattaattttaggaacttcgttatgttcaaatcgaacatcaattacaggacccataacttgagttacacggccaattcccatgctattttcctcctttaaatattattcaagcgctgcggaaccaccaacaatttcagtaatttgttgcgtaatttctgcttgtctcgctctgttatattctaatgataagtcatcaataagttcagttgcattatcagtggcatttttcatcgcagtcatacgtgttgcatgctcacttgcttttgcgtctaatattgttccgtaaatcaaactctcaacatattgaggcaagattacacttaagatagattctttatctggctcaaattcataagaagacaaatgaccatgccccttactagaatcctcttgagataatggtaatacttgtctagatgtaggcttgttttcaagaacgctgacataatgactatagtatatatttaattcatcaatttcttcttcactgtataagtctatagcatggttagctagtgcttgaacagatttgaaagaaggttgatc

SEQ ID NO: 73 - DNA, 1152 bp, Staphylococcus aureus
gatcctatttttaaacaagaagtagagaatcttgaaaaagaaataagaaatgtataagtaggaaactttgggaaatgtaatctgttatataacagcactaatgataacaatcattttttacatttctatatgctaatgtggcaagatgagcaaaactcattttgtggataatgtttaaaagtcatacacaccatacacaagttatcaacatgtgtataacttcgccaaatctatgtttttaagacttatccaccaatccacagcacctactactattactaagaacttaaaacctatataattatatataaacgactggaaggagttttaattaatgatggaattcactattaaaagagattattttattacacaattaaatgacacattaaaagctatttcaccaagaacaacattacctatattaactggtatcaaaatcgatgcgaaagaacatgaagttatattaactggttcagactctgaaatttcaatagaaatcactattcctaaaactgtagatggcgaagatattgtcaatatttcagaaacaggctcagtagtacttcctggacgattctttgttgatattataaaaaaattacctggtaaagatgttaaattatctacaaatgaacaattccagacattaattacatcaggtcattctgaatttaatttaagtggcttagatccagatcaatatcctttattacctcaagtttctagagatgacgcaattcaattgtcggtaaaagtgcttaaaaacgtgattgcacaaacaaattttgcagtgtccacctcagaaacacgcccagtactaactggtgtgaactggcttatacaagaaaatgaattaatatgcacagcgactgactcacaccgcttggctgtaagaaagttgcagttagaagatgtttctgaaaacaaaaatgtcatcattccaggtaaggctttagctgaattaaataaaattatgtctgacaatgaagaagacattgatatcttctttgcttcaaaccaagttttatttaaagttggaaatgtgaactttatttctcgattattagaaggacattatcctgatacaacacgtttattccctgaaaactatgaaattaaattaagtatagacaatggggagttttatca

SEQ ID NO: 74 - DNA, 3052 bp, Staphylococcus aureus; identical to SEQ ID NO: 65

SEQ ID NO: 75 - DNA, 6507 bp, Staphylococcus aureus
aacgaccacaaaacatacacaactacattttctctaattatttatataaatattttatcgtttaaaattatatcatgattctctaccattatgtataacttatttatatttttgcacaagatataatattgtccaactttaaatatccaaacctattaataataaaactagataccatcgtactctatcatggctttcttataatcgagtagaagcatcatcattacttgattatttgctctttacaacaccgagcgtgcccgtactcggtaattcaataccttgcgtaacccgtcactgtgagttgggttaatgataataaagcccacaccttttaaaaagatgtgggtaatttatataatttttatttacatttttaacttataaaaaaaagcgcctatgtcatgatttaccatcacataggcgcttatcaataaattattacttattactttccatttcatctaatttatgcggatttcctgtaattagatgacaacttattcttttcaggggaacattacacttttataatatgttcaaagacaaacttaaccattcacaaatataaagaataatattatcaaatcattgaacaaatcgtattttgcaacaattgatatttatattaatgtattgcatttaatttataaaattcatatacatcttaatattctcaatatcgatttgtattgtcaactttatatagatttaaaaaaataatctcatgtctttttttacaaaagtaagttaattattacaaactagtaacaaaaattatttcttcaaaaatatatttagtagcgaatacacttcatctttgaattgacttttactttcttccactgctccaaatttttgcgaaaaggatgctttcaaataccaactttcaagaaacagcaatattaaattctgaaagtcttcttttgtcatctttatctttgattcatcatagaattttgctatctctttacttaatgattgatttaaatcttgtatttgtccgtaaatatttccagaaaattcctcaggcgtattagataattgaacgtacattctaatatacctttcttcgatgtcgaaaataaactcaaataagaattgatataaagcatcaattgaatagttcgatttattttgattcatcataataatattattaaggtaatcaaaacaacatttaacactttgttcgtaaatactttttttcgagtcaaaatggtaatataaactcgctttctttatatttacacttttagctatatcatcaagtgttgtaccgtcataccccttctctgaaaataaggttattgcgttatcaataatcttatccttcaatttttataaccccctactgaaaattaatcacactatgttacaggaaaattaagttgcaattacaaatatttccgtttaattataacaacaatctattgcaaattaaaatactatcaattaccatatggcttacaacctaactaacgaaaggtaggtaaagaaattgcaattttttaactttttgcttttttatcctgtatttatgtctatttactggattgtcggttcaatttatttctattttaccagagaaattagatattcattgaacaagaagcctgacataaatgtggatgaattagaaggcattacatttttacttgcctgttataacgaaagtgaaacgattgaagatacgttgtctaatgttcttgcactcaaatacgagaagaaagaaattattatcattaatgatggaagttcagataatacagcagaactcatctataaaatcaaagaaaataatgactttattttcgtcgatttacaagaaaacagaggtaaagccaacgcactcaatcaaggcattaaacaggcttcatatgattatgtaatgtgcttggatgcagatactatcgttgatcaagatgcaccatattatatgattgagaatttcaaacatgatccaaaacttggtgcagttacaggtaatcctagaattcgaaataagagttctattttaggtaaaattcaaacgatagaatatgcaagtttaattggctgtattaagcgaagtcagacacttgctggcgcagtcaatactatttcgggtgtcttcactctatttaaaaaaagtgcagttgtcgacgttggctactgggatactgatatgattaccgaagatattgcagtttcttggaaattgcatttacgtggatatcgtattaagtatgaaccgcttgccatgtgttggatgttggttccagaaacattgggaggtctttggaagcaacgcgtgagatgggctcaagggggacacgaagtattactacgagacttttttagcacaatgaaaacgaaaaggtttcctttatatattttgatgtttgagcaaatcatctcgattttatgggtatatatagtgcttctatatttaggctatttgttcataacagcaaacttcttagactatacatttatgacatatagtttttcaatatttctactatcatcatttactatgacttttataaacgttattcaatttacagtcgcactctttattgatagtcgctacgagaaaaagaatatggctggactcatatttgtaagttggtatccgacagtatactggattattaacgcagcagtagttcttgtcgcatttccaaaagcattaaaacgtaagaaaggtggttacgcaacatggtcaagcccagacagagggaatacccaacgctaaaatcatcgctaaatattgtaagagaaacagcacttatcgctatatcttgtgtcttttggatatattgtttagttgttctactcgtttatattggtactatatttgaaattcatgacgaaagtatcaatacaatacgtgttgctttaaacattgaaaatactgaaattttagatatatttgaaactatgggcattttcgcgattatcatttttgtattttttacaattagcatattgattcaaaaatggcagagaggaagagaatcgtgaagtatagaaaatttataattttagtgttgagtatcttgatcatattgcctgtaagcacactggatggtcatcatattgcaaatgcagatgacgattcacctaaaaaactgaaatataaagaaaatagtgctctggcattaaattatcaccgtgtaagaaaagcgaattttctgaataattttatttacttcttttctagtagtaaagaaattaaaaattatagtgttagtcaatcacaatttgaatctcaaataaaatggctaaaatcacatgatgctaaatttttaaccttgaaagaatttttatattacaagaaaaaaggtaagtttccaaaacgaagtgtatggattaactttgatgatatggatgaaactatttatgaaaatgcttatccaatcttaaaaaaatataaaataccggcaactgggtttattatcacaggtcatgttggggaagaaaactttcacaacctcgatatgattagtaaaaaagaactaaaagaaatgtataaaactgggttatgggaatttgaaacacatacccacgatttgcataacttatctaaaaataataagtcaaaattaatgaaagcttctgaagctacaatcataaaagatttaaacaaaagtgaaaaatatctaactaaaaactttaaaaagtcgcagaaaactatagcctatccttatggcttgatgaatgacgataaattaccggtaatcaaaaaagctgggttaaaatacggtttttcattagaggaaaaagcagtcactccgaactccaatgattattacatccctagaatattaattagtgatgatgcttttgagcatttaattaagagatgggacggattccatgaaaaagattagacttgaactcgtatatttacgtgctattatatgtgcaattattattatcacacatttacttacacaaattactttaaaacatgaaaatatggagggtggatccttagtgttacaattttacattcgtaatattgtgatttttggtacaccttgctttattatcttgtcacagttactgacaaccttgaattaccaaaaagtcacctatagatacttaactacacgcgtaaaatatatacttattccttacatattaatgggattgttttacagttatagtgaatcattattaacagattcaagtttcaataaacaattcattgaaaatgtcctattaggtcaatggtatggctattttatcgttgttatcatgcaattctttattttgagttatatcatttttaaaattaactataacctattcaacagtaaaatattattattgttatcttttattttacagcaatcatttttatattactttacgaacaacacagcgtttcacgataccgtgctacactattatccattaagtgaaaatactataatattcggatggattttttatttcttcttaggtgcatatatgggttataactacgaacgtgtattaaatttcttagaacgttatttagttattatgattgtattagctgtagctacttattttgtgtttattgcgttagcaaatggagactattggaacgttaccagcttttcatattcattaacaccatataatagtattatgtttattgttatcttgggtatttgcacgcattttaaaacaatgttatttaatacgattcaaatgattagtgctttctcattctttatttatttattacatccaatcattctagactcattgtttgcatatacaaatatatttgaggataatacaatggtctttctagcgatatcactactattcattttaggattatgtataggtgtcggcatgatattgcgtgaattctatatctttaggtttattattggaaaacaaccatataaattgaacattaatgcttattaattattaagctatgttaaaaacacgcggtgggcgaaatcagtttgaattgactgacttcgttttaccgcgtgtttaatattgttatacatatattctaattgcacatttaaacttcgtaaatgccaatgggagtgggacagaaatgatattttcgcaaaatttatttcgtcgtcccaccccaacttgcacattattgtaacctgactttccgccagcttctatgttggggccccgccaacttgcacattattgtaagctgactttccgccagcttctttgttggggccccgccaacttgcattgtttgtagaatttcttttcgaaattctttatgttggggcctcgccaatgttttacttgaataattcttttagaattctaaataatgatccgattaattgaaagaagtctgcagtcattattaattcctccctttactttataaattatgcttgcttagtatcagtcagcttttcagttttcactaaatcgtctgctaaatgatgccaaaaatcttgtaattcttctcttgtgcgcactgtatcagaactgtcttgtcctacaaagtcaacatgatcccaatcatgttttgtaggcgtcacttgccaaatgcctttttgaattttatctgtcgcttttgtataagcttgattaaatggatgttgagaagaaataacggatactaaaccatcgttttctcgccattctttttcagtagctttaccgattaagttaccagtaatcacaaatgggaaaaacatatttaagtctgctttttgtctatcgctatttaatgctttgtgcgttgcttcaccagtgtatgttttatacacaatgttagggttcaacgacgttttacgatttaaatctgttgcaccctcacgcgtcagatcgtaaaatccattatcttttgatttccataaattagattgtttaacgcgtttgacataatcaatatatgattcatttggcttctgttttagaccccattgagccaacccgaagtctactcttgaatttttattaccaaacattttaccgatatcaaatacgatttgtctcactaaagcttcattaccagctaaatctgatgcgtgtgtaccattatgtggtgttcctaaagtagtaattgatgaaatcatattgtcatgattacctttgaatagtggagaaatttcgccaccatgtttcttttgatactctatttcttcacgattaccattacgcagtaattcttctagttgacgtatcgtttgaccgcccatactatgtccaactaggtgtaccttctgtcctggtttccagtctttgtaaattccttcgtatgtttttccataacgttcatgtccatattttgctgcatgtgctgcaccataatctacacgaccgcctttgatataataataaagttcaactgcgcggtcatagttacttccaaaagcacttatacttgcttcataagctttgtaaccattttcttctaaatcttggcgaatgttcattttattaccgccccaataatgagctaacactgaaggattaatatcatctgtaaacccattgaaaccatgcactaaaacgataggatcc

SEQ ID NO: 76 - DNA, 2084 bp, Staphylococcus aureus; identical to SEQ ID NO: 61

SEQ ID NO: 77 - DNA, 3822 bp, Staphylococcus aureus
gatcaaaattttgaattaaatactgtctcaatttaaagtcgagttctttaagtgaaatctcttctttataaatgtagtgtactctaccgtacgtagcaataccgtcaccttcatctctcttgatttgaaatcttggtgcgtttatataatcataataagcgtcttgatttttcttagtgacaccaccatatgaaaacactgtgccattacggttttccgcttctttaacaacaaatatgtctaatcccggatttttacgtgctttaaatctttcaatatctttaccaaatatctgtactcttgtgaattttctatttttatcaaagataaggtaatgcttgccacctttgctataacgataaccagtaacatttttaagttccttacttgcgccactatagtaatctcttaagtcaaagatatcttttgtcacattttcatattttgctttatgttcactcgcatttacagtttgatgcaatgacgttattgttcctgttgctaaaatacctaatgctaaacttgctttcgcaattgctgtcattttcatagttgtatgctccattcgtaattattagatttgttcgcttacgtctattgaatcatacagctttattatagttagcgtatttgacctttcacattaaaccatgtttaataatcattgaatcattattaagtaaattaaggaatctataatgttcgttaaataaaactgatcccgttgtgcttcacacccgatagatagggatttacagataaattcaggtctcttccacgtcatatttggacccatcgaaaattcgggttctcaaatcatcgaacataacaaaagaagctaagcaacatgtaggccgttgtcacttaacttcttgtttttccgatgacagcttctatttagagaatgtcatgattattttatattcacttcaatgttatcaatattagtgccatctatgacatctgccatgcgattttcttgtaattttttgtgcaattcaaacgtgtactttccaccgtttttcattttaataacaattttacctgaaccaacgttaccgtacagattatttttttcaataagttgttttctcaatttaaaatcaagttctttcaaggaaatctgttctttagtaatcttgaattctgaaacatcatgagagattgtacctttattatcttccttagtaattcttactcctgctttgtgatcaacttttttactattactctttgtgataccaccgacagaatatttttccagattgtaattattttcttctaaaacgacaaatacatcgacattcctatgtactccttcaccatattttttatcatctttaccaactaaagcaattttatatatgaaataatctgggacaacattcataaatcttattgtcgtccatttttttaaaataataccaatctcatttttaaattctaaacttggtttcgtataatacgctcttaaatctttaaatttaggatttatttctgttggtacttgttttgtggttggcgattgtggtgtgtctgatttagtagattgcattggttgtggcgtgtttgttgatggaggtgttgtcactttagttgaaggcggtgttgtcgcatttgctgtttgttgcggtgcttctactttagttgagggcggtgttgtcgcgtttggttttgattgcggtgcttctattttagttgagggcggtgttgattgtggtgcttccactttagtggaagatagtgttgtcgcgtttgctgcttgcgttgtcgttgtgattacacctgttgttaaaaggcctagtgctaaacttgttttagcaatcgttgttattttcatagttgtatgctccattcgtaattattagatttgttcgattacattcattgaatcatacagctttattatagatggcgtattgctccattcacattaaaccttgtttaactatatttgaatcatcgttaagtaaattaagaaatccataatgttcgttaaataaaaatgattttgatgtgattcaacacttggcacatttgaagtttcgtcacttttaagacatagaaatgccacttttacaaacaaatgaatattcgtctttttacatcattacgcataataaaagaagctaagcaacatgtaaaccgttgtcacttaacttcttgtttttccgatgacagcttctatttagagaatgtcatgattattttatattcacttcaatgttatcaatattagtgccatctatgacgtctgccatacgatgctcttgcagttttttgtgtaattcaaacgtatatttcccaccgtttttcattttaataacgattgttcctgaacccatgttaccgtaaagattatgtttttcaataagttgttttctcaatttaaaatcaagctctttcaaggaaatctcttccttagtaatcatgtattctgaaacatcgcgtgaaatcataccttgattatcttttttagtaatgcttaattctactttgtgattaacttttttactattagtcttcgtgatgccaccgacagaatattttttcaattgatatttattgtcttctaaaacgataaatacatcgatattatcgtaaggtccatctttatattttttctcatcttttccaactaaagctattttatagatgaacctatttggaataacattcataaacctaaccgtcgtccatggtttgagcataaatccaaactgcttttcaaattcaaaactcggttttgtataatacgctcttaaatcttcatatttaggagtcatatctgtttgtgcttgttttatggttggagattgtggtgtgtctgatttagtagattgcattggttgtggcgtgtttgttgatggaggtgttgtcactttagttttcggcgttgtggattcggttgtcgtttgtgattgttcttgtttaggcgctggcgttgctgatatattaagcgttttctgctcttcttgtttaggttgtgatattttttctattttggaagctgaggttttttcctcattagtatttggtgccttttcgagtttaggcgtgcgttcttgtcttgtgttagctgcttgtgttgtcgctgaatttgcacctgctgttatgtttatcattgctaatcgctctgctttaagcgttggtactttgtcaactttagttgattgtattttttctgctttgaccgattgcgtcgttactgtaattgcgcctgttgttaaaagccctagtgctaaactggttttagcaattgttctcattttcataattgtatgctccaatctatattatattcgattgtctttttacgtaatttgaatcatacaacatcattatagatggcgttctaagataatcacattaaaccccttttaacaattattgaagtattattaagtaatttaagcaaaaaataatgagtgagtatgagattaatatagcgtttctatgtgcctttgaaataatttttaagcattaaaaagaagttaagcaacgtttgatcgtcacttaacctctctatttcaatttcaacttatttcgtcatcaagtatatgtgttatgcttttataactttgatttcaattctatcaatatctgtgacattgataacatcggacatacggtcttcttgtaactttttatccaattcaaatgtatactttccatagtatttctttttgactgtaatttttcctgtactcatttcaccgtaaagaccataattatcaataaggtattttcttaatttaaaatcaatctctttcaatgacatcgcttctttatctattttaaatgggaaaaagtcataatcat

SEQ ID NO: 78 - DNA, 2326 bp, Staphylococcus aureus
gatctgctaattcgtttgtatttttcacaacaatttcatgcgctttttcttcacctaaaaaatgaaactcgtttaacatttcatctgtagttctaaaatgtgcttccggtaaagttgagcgattaagtggattgccgggttgtgatgctattaaaattttacgtgcgataccatcatgttcaaacaaatagtgtgcatttcctgtcgcaataacaggtatacccgctgtgtcacctgcatgtattaaacgttgataaatttcatgtaatgtttcagtatctctaataagctctctatcaattaaatcttgataaagtgccggtggttgaatttcaataaaatcataatatttggcaattttttcaacttgactctggtccttctgcataactgccgtaaataattcaccttcatcacacgctgtacctaccaataatccctcacgatattcatctaacaatgaacgtggaattcgaggtgtacggtagaaatacttcaccaatgatgcacttacaattttaaatagatttttaagaccttgttggttttgtacaattaatgtgacatgactaggtcttgcacgtttatatgcatcttcattactgagttttttgttgatttcgttatgatttaatacgcctaattctttcatttgttgaaccatttttatgaaaatgtaagctgttgcttctgtatcataaatggcacggtgatgttgcgttaattctacgccatattttttagccaagaaattcaaaccatgtttaccatattcagtattaatcgtacgagataattctaaagtatcgataacaccattcgttgatggtccaaacccaagacgttcatatcccgtatcgatgaagcccatatcaaacgaagcattatgcgctacgaatatcgcatcgccaacccattctttaaactctgtaagtacttcttcaatctcaggggcatctactaacatatcatcagtaatatgcgtcaaattgataatcgtttccgataatcgttcatgcggattactaaacctttcaaacttatcgatgatttcaccgttatgaactttcacagctgcaagctcgatgattttatcatactgatttgataaaccagttgtctcaacgtcgaacacaacataagtagcatcttttaatacgacatcttgtggtttgtatgcaatcggaacaccatcatcaactaacataccttccataccgtatatcattttaatgccatgtttttccgctgctgcgtgagcatctggaaatgcttgcacaacattatggtctgtaaccgcaatggctggatgtccccagtctgctgcctgtttaacatacgcaccaatattgggtataccatccatttggctcattgcagtatgcaagtggaattctacacgcttttcttcagccttatctttttttgtcgcttttttaatctcttcaatatcagacatcatcataactaaatctctaataaatgtatcttcttcaatacgaccttgagccctaacccatttaccaacacttagcgctttaaaatgttctaaatcatctttgtttttacgagtaaacatttttaaaactaaagagtccgtatagtcagtcactttaatttctacgatatggcgaccacttttaagttcttttaagtttatatcaaaaatgacaccctctattgcaactttaaactcttcctcaataatagattcaattggtttaatattttcaatttgaatcggcttaccaatttgacacttatcgacagcactttcgttgttatcttgttgtttcgctttttcagctttcattttttcaagtttctctgttgccaatcgtgcactttgttcgtcttcttcttgaatatgtgcttctaaagaagctaagttttgttcttgatcattatcatttgtttcgaatatgattttatcgatatcaaaaccacaatttctaaacgctttgataagacttccattacatgccttatcaaaatgattacgttcaatgtcatttgataccattacttttaatacttttccagacataataagctttttctgtttcaattgacctttaacttttggagataaagctgtttggtcaatacagtgcccaaagtatttaattgcatgttcatcttgattcgtgccatttgttaccgtaaaacgacatgtaacgttggcgatatctttaaactcttgctctattgcatttataaataataaataatcttcatgagctaagaattgtggtaatgtaatatgaaattcccatgttctgtttttgttagaaacatctatacgtgtcagttcacctgaatttaa

SEQ ID NO: 79 - DNA, 1793 bp, Staphylococcus aureus
gatccagcgagtggttacgctagcattttaggtatcccaacattacaaacaggtgtgttcggcggtattataatcggggccctggcagcttggtgttataacaagttctataacattaacttaccatcttatttaggtttcttcgctggtaagcgtttcgtacctattatgatggctacaacatcatttattttagcattcccaatggcattaatttggccaacgattcaatcaggattaaatgcattcagtacaggattattagattcaaatactggtgttgccgtattcttatttggtttcatcaagcgtttattaattccattcggtctacatcacattttccacgcaccgttctggttcgagtttggttcatggaaaaatgcagctggtgaaattattcacggtgaccaacgtatctttatcgaacaaattcgtgaaggcgcacatttgacagctggtaaattcatgcaaggtgaattccctgttatgatgttcggtttacctgcagcagctttagcaatttatcacacagctaaacctgaaaataagaaagtagtagcaggtttaatgggttctgctgctttaacatcattcttaactggtattacagaaccattagaattctcattcttatttgtagcaccattattattctttattcacgcagtacttgatggtttatcattcttaacattgtacttattagatcttcatctaggttatacattctcaggtggtttcatcgactacttcttactcggtatactacctaataagacacaatggtggttagtcattcctgtaggtcttgtatacgcagttatttactacttcgtattccgattcttaattgtaaaattaaaatacaaaacaccaggtcgtgaagataaacaatcacaagcggctactgcttcagcaactgaattaccatatgcagtattagaagctatgggtggcaaagcaaacattaaacatttagacgcttgtatcacacgtctacgtgttgaagttaacgacaaatctaaagttgatgttcctggtttgaaagatttaggcgcatctggtgtattagaagtcggcaataatatgcaagcaatttttggtcctaaatctgaccaaatcaaacatgaaatgcaacagattatgaatggtcaagtagtagaaaatcctactactatggaagacgataaagacgaaactgttgttgttgcagaagataaatctgcaacaagcgaattgagccatatcgtgcatgcaccattaactggtgaagtaacaccattatcagaagtgcctgatcaagtgttcagcgaaaaaatgatgggtgacggtatcgctatcaaaccttcacaaggtgaagttcgtgcaccattcaacggtaaagtacaaatgattttcccaacaaaacatgcaattggtcttgtatcagatagtggtttagaactattaatccacatcggtttagacactgttaaattaaacggagaaggctttactttacatgttgaggaaggtcaagaagttaaacaaggtgatttattaatcaactttgatttagactacatccgcaatcatgcaaagagtgatattacgcctattatcgtgacacaaggaaacattacaaaccttgattttaaacaaggtgaacatggcaacatttcatttggcgatcaattatttgaagctaaataatgcttactataaacaggtgcgtataccttcataaggtgacgcgcctgttttttctttgctattgtattttgcagcatcattgatagttcgctctcccc

SEQ ID NO: 80 - DNA, 3581 bp, Staphylococcus aureus
ccttgagtatgtttacctaaacgttcttgagtaagctcatcagctttattcatcgcttcattagtagctgctaacactaagtcttgtagcatttcaatatcgtctgggtctacagcttcttctttgatttcaacgtcgacaacttctttatgaccagttacagtaactgcaaccatgccaccgccagctgttcctacaatacgctcttctttaagtttttcttgttcttgagccattttcttttgcattttttgcatttgtttcatcatttgttgcatgtttccgccaccgcgcatattccatttcctccttgaaaatcaataaatatttatcaataaaatgatgtttctttcattatacatacgattatatcgcttgtcatgtatcactcttcatctatcacatgtacagtttcttcaccgaaaagatcttttgctttttgagcaatatctgtttgttgtgcttgttgctttggcatatcatcgccttcgtttttacgattttgtaaatattccgttcgaactctttgccattgatctgatggtacaccaacaactttaacgtttttattaacgatattacatacaacactttctatactactacgtttctcgtcgtctttattgacgatttcacaatggatctcttcctcaaatttcacaagtacgtgatcttcacttgccgccacaggttccgaattttgcaataaactaacgagtgattttttatcattatttttggcatgatcaatcacttcttgccaatgatctttcaacaatttgatatctgccttattcgctttatctagcacttttgcaatttgttgcattgaaaatgcatttttagatttttgtatgcctctcgcaggctttttcgaagatttttgaacaggagcgacactcactccttgtgcttttagtgtttttagttcttgctctaactgttccatacgttgcaacaatacatctgtgtttggcgatgaagcaatttgtgctggttcagctacattcgcaatcacttgtggttgacccttaatctgctcagctaattttactaacaacacttcaaaatgaacgttttgattcacactaaaacgaatcgacactaatgtatcattaataagatcaatcatttgatataacatatctaattctaagttcatcagtgctcgatactcagtatctttctcagatgttttattcataatcgtatctctgacaaaataaatcatatcatttattaggcgattcacttctttaccttctgttataaactgatggtattttttaaaagatgcttgtacgtcaccttgtacaatatcatcaaacaagtgatccaacgcttcatcatgtacgctacctgtgacattcaacgcatcttgcaatgttaacgtaccatcaccaaatgcaatagcctgatccataatacttaatgcatcacgcatacccccttcagacgctttagcgataaatgccaaggcttcatcttcacattcaatttgttgtgcatctgctacaaattttaaacgttcaacaatttgatctaggctaattgctttaaaatcaaaacgttgtgccctagaaatgattgttggagggattttatgtggttctgtcgttgccaatataaaaatagcgtgtgctggaggttcttctaacgtctttaaaagggcattaaaagcacctgttgttagcatgtgcacctcatctataatataaactttatatttcgattcacttggtgcatatttaactttgtctctaatatttcttatttcatcaacgccattattactagcagcatcaatttctatcacatctgaattagtcccctgcgtaatgcctttacaaatatgacattcattacaaggttctccatcagtgctatttagacagttgattgctttagcaaacactttggcaatactcgttttccccgtacctctcggaccactaaaaatataagcatgcgactgtttttctttcgaaatcgcattgcgcaatgtcttcgtgacatgttcttgtccgacgacatcctcgaaactttggggtctgtacatacgatataaggcttgataattcaagttagcacctccataaacaattacctctcattatagcatgataatacctttacttcttaattgaacaattaataaaaatgttctggaaattttacgattccgtgtggtgcatccgtcaaattatcccataaatattttacaagtaacggtgcatcaccagattctaatttaatgtcatgctcagcagcattttgataacccaacttttcaaagtagtcaaaacaatggtctacaacaaccgtactatactcttgtgctttggcacgctcttctactgcttgaaccaagccacgacctaatttttgtccacgtaattcaggatgaactgataaagaggcaatcgccaaaccataatacgtcttatcatcactattaatttctacttcaattaataaaacgtgtccaacgacatcgttattttcatttttcgctattacttctaattcaaaattatagcaaggagattttcttaaatgttttactttcgcacgtgcttgccaactcgtttcaggattatcatcaaaactttcttcaatactatttaaagatttatcataatctaactctgttaaagtacttaaatatatttgcatatgtcctccgtaggcatttgattgtcaataatcataacgtatctcattaataattctattgtaagatactccccctcatttcaccatcatttctttatcatcaaattataacttcttacttttcattgacacaaaaatcattcaaactgcacatcgagttcacttgaatcaaacttcacatataaaaaagctacttcccacaaacatgttccacgtataatacgctgaattgtcttcaagaaagtagcttctataattatatattttcaactcttaataatcggtttaatatttaaaaaataaaaaaccgtgcacctaagcatcgaacgtaattcacgaacgtaaccaaagtcgttagctaaatctcggctaccctacggcacatatgatgatccacttaatgctgcttccgtcaggacctgacatggttcatgggttcatattgcataggaccgaaatcttcaaacactacgtgctttgggcagacttcgcaaaaatacggcctcaacaaaggaattaagcctcgcataaagcggatttcgagtacagggaaccgctacctccccacctagcacggcaagatatatattactatattttaatagttaattgcaagtataaatcatttatatcattgtttactttatacgacgtcttgagaagtcattaaatttaaattcatttgcaagatgttttgaaatattatattgaaacggcattgtattttctaaatacacaatacttcgaactgttgctgaataagccaccgatacatcaccaaacaattgatatgcttgttcatcaaacggttcaaaagtaatagacttacttgaataactaatattaagatttaataccttttccaaataatcataaatagaatcactcgcaacatcattacctat

SEQ ID NO: 81 - DNA, 388 bp, Staphylococcus aureus
cttctaacatattaacccactcgtttgtagcagcgttaaaaccaacacccggctctgcgtttttcaaacgttctacaataacagaaccttctaatcctgcattttcagcaatttgacgaactggtgcagttaatgctttaagtacaatatttacacctgtttcaatgtcaccttcagcttcaatttcacttactttttggtaaacatttactaatgcagtaccaccacctgcaacaataccttcttcaactgctgcacgtgtagaatttaatgcatcttcaatacgtaatttacgttctttaagctctgtttcacttgctgcacctactttgataactgcaacaccacctgctaatttagctaagcgctcttgtaatttttcacgatc

SEQ ID NO: 82 - DNA, 1384 bp, Staphylococcus aureus
ctaataaatgcacccttttgtaaccaatcatattcaatgtatggttgatccgttacggtacatgtaatgactacttcaccatttgatactgcttctttagcattttctgtcgcaataaaattaatttccggacgctgttgttgccatctatcaacaaagcgtgcacatgcttcagagaattgatcgtaaacaaacacgcgttcaatatgatcgaattgctctaacatactttgtaattgcttgtctccgattagcccgcatccaatgattgttaagtctttaaatccttttttagccaaatgctttgctgcaatcactgaaactgctgcagtacgcatactactaattaaacttgcttccataactgcaattggataattcgtttctggatcattcaaaataatgacgccacttgcacgctccatattacgtttcgatggattgtcgtgcttactacctatccacttaatacctgaaattgcgtgttcaccaccgatatgacttggcattgcaataattcgatctgcgatgtgtccattttcaggatcctgtcttaaatacggcttaagcggttgtacaaaatcattgtgcgcatgggctgttaatgcttctgttaatgcgtccacataaacttgtgaatgattacctcccgcttgttcaatatctgatctatttaaatacaacatctctctattcattctgatttaactccttgtcttgatttcattttttctaaccatgtatctgaataaactaaatctaagtaacgatcgcctcgatctggtaaaatcgtgacaattgttgcaccttcttcaattgacgttatcaactgctcaatcgctgcaataatcgaacctgttgaacctccggcaaatatgccttcataatcaatcagttttcgacagcccaaagcagattgataatcatctacatggatcacttgattaatttctgatctattcaatatttcgggtacacgactagcaccgataccaggtaattctctattaataggtttgtcaccaaaaatgactgaccctttcgcatcaacagcaacaatttgtgcgtttggatgcacttcttttatttttctactcatacccataatgctacctgtcgtgctgactggcgcgacaaaataatctataggttgcttaattgtttcaacaatctctgtgcctgcaccatgataatgggattgccaatttaactcattcgcatattgattaatccaatatgcatcgtcaatagtggctaacagttcttgcacctttgcaatacgagtcattaaataacccccatgtgcatcaggttcttcaaccatttctacattggcaccataacttttaataattttcaaatttgttggtgatattttaggatc

SEQ ID NO: 83 - DNA, 1464 bp, Staphylococcus aureus
atcttgtaattcttgtgccccaacgtttgatgtcattatgataattgtatttctgaaatcaactgtacgtccttttgtatctgtcaaatgtccatcatctaaaacttgtaatagaatattaaatacatctggatgagctttttcaatttcatcaaataaaattacagaatatggtttacgtctaactttttcagttaattgtccaccatcatcatgaccaacatatcctggaggagcaccaactaatcggctcactgcgtgtttttccataaattcactcatgtctacacggatcatcgcatcatcatcgccaaacattgattcagctaaagctctagctaattcagttttaccaacaccagttggtccaaggaagataaagctaccaattggtcgtttaggatcttttaaccctgcacgggcacgtctaaccgctttactgattgaattaacagcatctttttgcccaataactctctcatgtaatgtatcttctagactaagaagtttttcagattctgtttcattgattttagttaatgggatacctgtccatcctgcaataacttcagcaatatcttcttctgacaatgaagttgacatgccattttgtgcattcttccattcatttttagcttcttcatattgcttttcaagttttgtttgtttatcacgcaggttagcagcattttcaaactcttgagcatgtactgcggcatctttttcatttttaactttttcaatttcttgttcaatttcttttaaattattaggtgtcgtatgactcttaagtcttactttagaacttgcttcatcaattaaatcaattgctttatctggtaagaaacgatctgaaacgtatctgttacttaatttaacagctgcttcaatagcttcgtctgaaatattaatacgatggtgtgcttcgtaacgatctcttaatccttttaaaatagcaactgtatctactactgaaggttcatcaacttgtacaggttggaaacgacgttctaaagccgcgtctttttcaatatttttgcgatattcatctaatgtagtagcaccaatacattgtaattcaccacgtgctaatgccggcttcaaaatattcgaagcatcgatagcaccttcagcaccaccagcaccaactaaagtatgcaactcatcaataaataggatgacattacctgcttgttggatttcttccataacctttttcagacgctcttcaaattcaccacgatatttagtacctgcaactactgttcccatatctaaagacataacacgcttatcttttaatgtctctggtacctcattattcactatggcttgcgctaaaccttcagcaatagcagttttaccaacacctggctctccaataagcacaggattgtttttcgtacgtctacttaatacttcaattacacgtgtaatttctttatcacgtcctataacaggatc

SEQ ID NO: 84 - DNA, 2248 bp, Staphylococcus aureus
tatataaatgatcatttcaaatgatataaatattgtgagagtgatacagaattgatagacaatgctcacctgtatatgatgacatgaagcattttaaaactaccgcaatctcaacataaaaataccgagacttccaaatagaaacctcggtacatttacttcaattatatttatacatcatcatagctgacttctttttcagctacagttttaccgtcaactttaacaatataacttgctgtttttcctttttcaattcttaaaggaatgtctatacgttgatcactagtaatatcgaaactacctttttcagttgaaccgtcattatctttatctttaatataaactttaactttttgtgacttatcatttttaccagtgtatggtacatctaccgattcagttgtcgttttgacatctgatgagtcactttttttacctttagaaacaacaaatgaaatcgttgacccctcatctactgattttcctttaggagattgagaaatcacatcaccctcatcaatatcgtcactatactcttccttactttcaactttaaaccctttttcttctaaggcttttttagctttgctaaaggatttatgttcaaagtcttctacataaacttgcttaatgcctaaagattcatatagtttaatattagaatcatgaatagcgatttcagtatttgcggttacactttgatttgcaatgtatccttttggcgcttgattattatatactttttcaatcgtaacatctttaagacctaacgattttaatttctgcaaggcttcctccttaggtaaaccaatgacatttggcattttaaccttttcagggccctttgatataacaacatcaacactgtcaccacgttcaacacgttcaccagtattaggagttgtcttaataatttcattttcaggatatttatcactataacttctagaaattttacccaatttcaggttgtttttattgaatatttgctctgcttcttttacagatttcccgattacatcaggtgtctcttcgtatttattaccaaacattgccattgccacaaaagaaacaagtgcaatcattaacaacgaaaagattagtgataagagcacaatctttcgtgttgatttctttttaggttttggttcgtacaccgtaccttctggcttttggaattgctgatgatgagcaggcccatttacaataggtacttgcgtcgtttcacgtttaggttgattcgacttatgttcactaatatgctttgctagatcttcttttttcaaaggtaccgctatcgttttcattttatcgagttcatagacatcttcattcgctcgattttcatgtaaaacactactcaaatcatctttcatttcttgaattgttttgtaacgattcgctttgtctttttctgtagcgcgtaaaatgacattacttaaagattgcggaatatccttacgtacatctgttgtcacatttggcacagaatcctgaatatgtttaatcgcaatgctaactgcagtttctccattaaagggtggttcaccaacaagcatttcatataacacaatacctatagaataaatatctgtacattcatccgttgcctcaccttttgcttgttctggcgaaaagtactgcacagtacctaacacatgattagtctgagttaaagacgtctcacttaaagctttagcaattccaaaatcaaatattttcaacgttttattgctgtcaattaatatattttgtggcttaatatctctatgtacaatacgcatatcatgcgcatgtttaatgccatccaatatttgattcgtaaaattaatcgctgtgtcaacacttaatggcccatgactttcaatatactcagacaaagtcggaccttcgatatattccattactaagtagtaacagtcatcttcttcatcaacatcgatcatacttactatattttgatgtgatagctgtgatgagttatgtacttctcgttcaaaacgttttaatgtttcttctttttctctaggtggtataaaaatcgccttaattgcaactttaatgttaagtatcgtatcttcagcaagataaacggtactcatgccaccgccgccaagcttatctacaattttatatcgttcatttattattttacctatcatactttatcaccttcaatagccgcgagtatgaaagtaacgttatctttcgaatggttatctaatgccaattgcattaattgatc

SEQ ID NO: 85 - DNA, 1606 bp, Staphylococcus aureus
taggtcctcatcagcaatcgctttttcaatttctggtaataaaggacctgaattaccgatacaagttgtacatccataaccaaccaagttgaagcctaaatcatctaaataaggttgtaagccagcatctcttaaatatccggtaacaacttttgatcctggtgctagagaagttttaacgtattcaggaactttcaagcctttttcaactgcttttttagcaactaaacctgcacctaacattacataagggttagatgtatttgtacatgatgtaattgctgctattgcaatatcacctgttttcattgtagcttttgatccatctttaaagttaatttcagctttcttatcaaattcacttttatctaaaccgtgtccttggttgcctgctggagctgttacagaattttcaaatgatgatttcatatcacttaagaaaattaaatcttgaggacgttttggtcctgaaagcgatgcttcaactgttgataaatccaattcgataacatctgtataattaggatcttctttctcaacatcaaagaacatatggttttgtttcaaatattcttttactagcgcgatatgttcgtctgatctaccagttaacttcatatatttaagagattcatcatcaactgggaagaatccgcaagttgctccatactctggtgccatgtttgcaattgtagcacggtctgctagtggtaaatgttgtacacctggaccaaagaactccacaaatttaccaacaacaccttttttacgtagctcttgagttactcttaacgctaaatcagttgctgttgcgccttgtggtaatgaatttactagtcgtacaccaataacctctggaattgggaaataagaaggttgtccaagcattccagcttcagcttcaataccaccaacaccccatcctagtacgccaataccatttatcattgttgtatgtgaatcagtaccaactaatgtatctggaaatgcagttttttcaccatctacatcacgaacatgtacaacacttgctaaatattctaagttaacttggtgaactattccagttgcaggaggaactgcattgtaattatcaaatgctttcgttgcccaatttaaaaactgataacgttcatagttacgttcaaattctaatttcatattacgttcaagagcttctggatttgcatagctatccacttgaactgagtggtcaataactaaatccaccggtacttctggattaattttagtaatatctcccccaacgtcatccattgctttacgtaaagaagctaaatcaactacggctggtacacctgtgaaatcttgtaaaataacacgagaaggtttaaatggtacctcgccttcatttccatcttttccaaactgacttaaagctttaatatgatcgtctgtaattacaaaatcatcttcttgacgaagtaaagattctaacaaaacacgaattgaataaggtaaattggaaactttagtaataccttgctcttctacagcttttaaatcatagtaagtataactttggccattcaagtcaaaatgtttttttgattgctctttaaaatttgcagccatttaatgatcc

SEQ ID NO: 86 - DNA, 1409 bp, Staphylococcus aureus
tgcgttctcttcaacacatggcgcatcatcttctaaatgactacccataaattgtttaacaaattcactttgaggattatttttaaatccttctggtgtgtcaatttgttcaatatgcccttcattcaaaagacaaatcttatcaccaagtttcatcgcctcttgaatatcatgtgtaacaaatatgattgtcttcttaattttagtttgtaattcaattaaatcatcttgaagtttttctcggctgattgggtctaatgcactaaacggttcatccattaaaataactggtggatcagctgctaacgcacgtataactcctacacgttgtcgttgcccccctgacaattcatcaggttttctgtttttatatttttcaggttctaatccaaccatttcaagtaattcatctactcttttatctatatctttttctttccactttttcatttgtggcacttgtgcaatattttctttgattgtcatatgtgggaataatgcaatctgctgcaatacgtatccaatatcccaacgcatttcgtatactggataatcacttattggtttatctttaaaataaatataaccttcacttaagtgaatgagtcgattaatcatttttaatgtcgtagtttttccacaacctgaaggtccaattagcacaaaaaattcaccctcattaatattgaaactaatgttatcgacagcaacatgtttgccataacgcttagttacatttttaaacttaatcactttgccacctctttttttctcatagcataaaaccgagattatatgtatgtattccctatttaaccacgtttattacaattttcaaatttaaatgatttatccttgaacttttttaataaaataatgaataataggtaatctccagttaagaaatagtgttattttaccttgaattcaaaaaaacacccagtaaaacaaggaatgcttactaggtgtcttcactatactttggctttataattttgaatcgtttctaaaaatgctggacaataatgttttaatttgtaactacctacgccatcaatattaatcatatcttgtttcgaagcaggcttacgtttagcaaattcctccaacgtgtaatcagaaaatatacttacaggtgctatcgttaatttgtcacttaactttttacgaacttctaccaactgactgaataatactcggtcaaccccttcaaccgtatttataaatactttttcagtcgctttttgcttaaatggtgttgtgaatacttctacttcattactgagtaattttttaattgaagtatcacacattaatatttcgtcattttcatttaagaaccctttgaatcttaattcatctattaagtgacttaattctgatgttgtgtaacctttcattaaaccatg

SEQ ID NO: 87 - DNA, 126 bp, Staphylococcus aureus
tggacctgttaatccagaagtcggcaatatgtttaacttcactgaaacgtaaataataagtattgaagctatccaatatgatggtaatgcagttagaaagaaagccactgaacgtatcgcacgatc

SEQ ID NO: 88 - DNA, 2238 bp, Staphylococcus aureus
gatcttcagcttgatgttttcgtttgattaaattggtaaaatagaaacgcaatccacaaaaatggcaagcactaaaataatgtttgggggtgcttgtgcttttgtggattgcggtcgattatttatattgcatgatttgattaatttgattgattatattggacatgatggtgttggcgggatgcgttgttgctagtcgcgggctttgtccactccacatatgtattaactctttgtcgccgatgtttgctgcggcttttcttatgctacttgttagctcattttgtattggataatctgggatatcgccttcgtattgggacatttcttcgataaacctattgttgataccgcgtgcaagctttccactaaacgcttttgtaatgactgtatctgtttctttactatttataattgcatctcgcagtagttctgatgcattactgtcttgtgatgttaaaaatgcggtgcccatttgtaccccttctgcacctaagacaatacttgccaaaactcctctaccatccataattccaccagcggcaatgaccggaattgaaacgacatctacaatttgtggcactaaagatattgttccaaccataggtaattgatttttaggttttaaaaatgaaccacgatgtccacctgcttcactaccttgagcaacgatagcatccatacccgctttttcattcgcaatagcttcatcaacacttgttgctgtacctataagtttgacattcgctgctttcaacctgcttataatctgttcgcttggaattccaaaagtaaaacaacatacaggcacttgctttttaattatcgtatcaatatgacacttaaattgttgttcttcggtaatttttacaaccggctcttctaaatgtaatgcgcgtcgataaggttttaaccatgcattcatattttcaatttgactactggtatatgattgttgacttggtacaaagacatttacgccaaaagaatttgacgttaattggcgtacataatctatttcatcttccaattgctgcgtattaaagtaacctgcgcctattgtgcctaacccaccactgttacttactgatgcaactaatttcggtgtcgtacttcctgccatacctgcttgtataattggatattcaatacttaacatttgagtaagtcgattcttattccacatagctgttcgctccttatatagatacgttgcgatttttccgttgttgaaattgaatttgctgttgagaaagtttttctttttcctttttatccatctcatcttcaatttccatacctaataattcttcaattaagtcttcatgtgacactatcgcttcagtaccaccaaattcgtccaacacaattgctaaatgttttctagaaatagtcatcttacgtaatacccattcagctttattgtgttcattcacaaataatggcttagctgaatagtttgtaatttgattttcttttttattactccaagccaacagatatttagaatgaaacaccccaataatgttatcaatatctccctcgtacactggatatctagtgtatggcttattcataaccgtttcataaacttcttcgtatgtcgcatttgaagcaaatgccgtcacattaattctaggtgttgtatctacatcttttacttttaaattttcaaaattaatgacaccttccaacctactcgtctcaatttcatttaaagcaccttcatgtccagcaattgctaacattgttttaaattcttcttttgaaaattgatgttcttgaggttggcccttagataaacttcgattaatactgtccgtcaacttatttaaaagtaatgtgataggacggaacacaatgacacaaatattaataattggatatacaagccttgttattttatctggaaatgttgcagcgacagacttgggaatcacttcggagatcaaaatgataacaactgttaaaacagctgatgcaataccaacgctaatcccccaacgtaaagccataattgtaacaagtgttggtaataaaatattcgcgacattattcccaattagaatcgttgtaataaactcacttggtttttcaagtaactttacaatgccttttgcttttttatcacctttgtcagcttcagttttaaattttgctttattggcagccgttaatgccgtctcgcttcctgaaaagaaaaacgaaataaatatcaatataattatggcaatgatc

SEQ ID NO: 89 - DNA, 3085 bp, Staphylococcus aureus
gatcttcaatttcacaaggaatccatgattgaatttgctttaatgtaacattaatcataataacaacctcagttagtcaattttgtatttatttttctgtttatcctggtgacgttctttagcaagctcgataagttttgtaatcaattctggataagataagcccatattttcccataactttggatacatactgaaagccgtaaatccaggcattgcatttgtttcattaatatatatttggttgtcttctgttacaaagaaatcagcacggactaaaccagaacaatctgtcgctttgaatgcctctaatgccatatttctaagcgttaattgaacatcttcgtctaagtcagctggaatttgtaattgaaccttaccatctttatattttgatttgtaatcgtaaaacgcgacatcttttacgacttcacctggccatgtcgcttcaggatagtcatttcctaaaactgctacttcaatttcacgtgcgttaacgccttgttctataacaagcttacggtcaaattggaatgcttctttaataccttctttaagttccgcttcattattacatttactgatacctacacttgaccctaagttagcaggtttaacaaagactgggtaatttaatttatcatttactaattttaaaatgttatgttcatatttttcatattcagaacgtaagaaactaatataaggtaactgtggtaaccctcgatgttcaaataattgtttcattacaagtttgtccatagaacttgcagctgacaatacaccatttcctacatatggtacatccaaaacttcaaaaagcccttgaatcgtgccatcttcaccattaggaccatgtaataatgggaatactgcatcgtatggttgtcctgaactactttctttcaatagctgtgaaatctcaagcgcctctccattttctaaatgaagctcatcagtagatttaatttcagctgtaatattattttgctttctccaatcaccatcattggtaatataaatgatatcaacatgatatttgtctttatctattgcatttaatacattttgtgctgtcagaatcgatacttcgtgttctgcacttttccctccaaaaacgatacaaatattttcttttgtcatttcgttttcctccaatgatatatcagggtttgctaccttaatataaattaatattgatttagtcctattgttaattgatttattcgcatctttgaatcttaatagtatcacattttaatgctattttgcattttaaaaacgaggacttatgtgtctgtatctatgttgattcatttataatcagaacaatattcccttctattttattcctaattcaaattgaaatctatagctgatatcactgtgatattctagctaatttttaaaaagtcatgtaaaattgatataaacattagtgagtataaaaggagtttgcaatgaattattcatctcgtcaacagccggataagcattggcttcgcaaagtagactgggtattagtagccactatagctgttttagcaattttcagtgttctgcttattaactcggcaatgggcggtggtcaatacagtgctaatttcggtatcagacaaattttttattacattttaggtgcaatttttgcaggtatcatcatgtttatttcacctaaaaagattaaacattatacatatttattgtatttcttaatctgtctattattaataggcttgctcgttattcctgagtcacctattacacctattatcaatggtgccaaaagttggtacacgtttggccctatcagtattcagccatctgaattcatgaaaattattttaattttagcattagcgcgtgtcgtttctagacataatcaattcacattcaataaatcattccaaagtgatttgttattatttttcaaaattattggtgtctcgttagtaccaagtattttaatattactgcaaaatgacctaggaactacattagtattagctgctattattgcaggtgtgatgttagtaagtggtataacatggcgtatcttagcacctatctttattacaggtattgttggtgcaatgacagtcattttaggtattctatatgcacccgcattaattgaaaatttattaggtgtccaactgtatcaaatgggacgaatcaattcatggcttgacccctatacatatagtagtggtgatggctatcatttaactgaatcacttaaagctatcggttctggacagttactaggtaaaggatacaatcacggtgaagtttatatacctgaaaatcatactgactttatcttttcagtgattggagaggaacttggctttatcggttctgtcatattgatcttaatatttttatttttaatcttccatctaataagattagctgcgaaaattgaagatcaatttaacaaaatctttatcgttggtttcgtcactttacttgtgttccatattttacaaaatattggtatgacaattcagttgttaccaatcactggtattccattaccatttattagttatggtggtagtgcgctatggagtatgatgactggaataggtatagtcttatcaatttattatcatgaaccaaaacgatatgtcgatttataccatccaaaaagtaattaatttaaactattttgagtttcaaatatcataacttttcaagatgacgttatatagtctatttacgtcgtcgatttaaaatgtcatatatagatattactcgataataacaatccctctttgaagtacacattgtaaaatgtacactctaaagagggattttgttatatagtacttgctttcattttagtaaatccagtcaaaaaagctatcatcgaatagtccgacgatagctttaacggtgtgtgattcacaatcacagtcaattattttaattcgtgacttactttattagatgctggcaaagtattaataatgtctaaacgagatttagtttttttaatattcacacctaatgatgacaatagtttgactacattttgaatcttttcaggacgtttcattattatcacctcgtttggatc

SEQ ID NO: 90 - DNA, 2001 bp, Staphylococcus aureus
gatcatggcattgtatttaatgcaagtctacctttgtacaaagatgccatccatcaaaaaggatcaatgcgcagtaatgacaatggtgatgatatgagtatgatggtgggtacagtgctgagtggctttgaatatcgagcgcaaaaagaaaagtatgataacttatataaattcttcaaagaaaatgaaaagaaatatcaatatacaggctttacaaaagaggcaattaacaagacacaaaatgtcggatataaaaatgaatatttttatattacatactcttctagaagtttaaaagaatatcgaaagtattatgaaccactgattcgaaaaaatgataaagaatttaaagaaggaatggaacgagcaagaaaagaagtgaattacgctgcaaatacagatgctgttgctacacttttttctactaagaaaaactttactaaagacaatacagtagatgatgtaatcgaactaagtgataaattatataatttaaaaaataaaccagataaatctacaatcacaatacaaatagggaaacccactattaatactaagaaagccttttatgatgataatcgtccaatagaatatggggtgcacagtaaagatgaataaaattaatgatagggatttaacagaattaagtagttactgggtttatcaaaatattgatataaaaaaagaatttaaagttaatggaaaaaggtttaaacaagtagacagttataatgatgataagaatagtaatttgaatggtgctgctgatattaaaatatatgagttattagatgataaaagtaaaccaactggtcaacagacaataatttatcaaggaacatctaatgaggcaattaatccaaataatccattaaaatcatcggggtttggagatgattggctccaaaatgctaaattaatgaataatgataatgaaagcacagattatttaaagcaaacagatcaattatcaaatcaatataaaataaagttagaagatgcagatagattatcaaatagtgattttttaaaaaaatatagaatggaatcaagtaacttcaaaaacaaaaccattgtggcggatggcggtaattcggaaggcggtgcaggagcaaaatatcaaggagcgaaacatccgaatgaaaaagttgttgctactgactcagcaatgattccttatgctgcttggcagaaatttgctagaccacgctttgataatatgattagttttaatagtaccaacgatttattaacatggttacaagatccattcatcaaagatatgccaggaaaacgcgttaacattaatgatggtgtgcccaggttagatactttaatagacagccatgtaggttataaaaggaagttaaatagaaaagataacacatacgatactgtaccactaatcaaaataaagtcggtaaaagatacagaaattaaaaatggaaaaaaagtaaaaaagactattaacataacattagatatggatgggcgaattccaataaatgtttggacaggagattcgattgcacgttctggaagaggaactttaattaaacttaatttagaaaatcttgatgcgttgagtaaactgattactggtgaaacaagtggtatgttagcagaatgcgtaatctttttaaatgaaagttttaacatctcagaaaatgaaaataaaaattttgcagatagaaagaaacaattatcagaaggatttaaggataagattaacttatttcagttagaagaaatggaaagaactttaattagtaaaataaactcacttgaagaagttgcagatgaaacaatagaaagtattagtgctgttaaacacttattacctgattttgcattggatgcattaaaagaaagaattaatgagttgtttaaaggtataaaatcttttatagaaaaagtgtatgatagtatagataatgaaattttagaaattttcaaaaatatagatcacgacttcagagatggagtatctgaagaaatgat

SEQ ID NO: 91 - DNA, 2070 bp, Staphylococcus aureus
tgacgctgcttttgtaaatacatataatttttccacttcatgatttaattcgttcgcatgatctttgtaatttctaccaaaagcaatcacattattcggaggtgttactggtggtaaaaattcaatgtcattaaatgaaattttatagtcttcagctttgccgctatcttctgctgctacaactgctttacgtacttgttcttgaaaatctaaagtatgattttgttgtaaaccagctaacaatgttttaggatggaaatctccttctgcaaagtcagcaaatacttgtgttaaatcccatacagcatcttcgcgttttactttaacgccatatgaagttttgtcattatacttgaatgataagaatttcattcattctcaactcctcgtctttatcttaattcacattataacttttttcgttatcaaataacaaataaataagtaagacaattttgaaaatgagttgtgttcattctgctacaaggactttgcacttaatcgaaattattttttattcttttgaaaatcaaaatactatagttgcaatgtaccaaatttgaagaagtataaataacctttaacttctttattaagaatcgtttgaagcgtattttgataatatttcatctgtatcttatatttattttttaattgtgtaccaatttcttcatctgtcatcccacggcgacgattaaatgcatcggttttatagtctacaaaataatgcacaccatctttaacaaagattaagtcaatcataccttgaataattgagacgtcttcgtctccttgtggcaattggtcaactaatgcttggttaactacaaacggtaattcacgataaacttgctctgcttcagcaataatcgaatataactcactattgataaatgtcattatttcatccatacggatatcttttttcgcatctgcttcgataatatgtttatcgattaatccatcgatatactgatgtaactcaacttcagatatgcgttcttttttgaatggtaaatgttgcatcactgtatgcattaacgtaccaatttcattcgcttttcgtttaccttgttcacttagaaatttaggtcgttcatacgttgaaaaaccgatacgatattgccttactcgttcgtaacttgtgccactttcttctgtttcatattgtcttttcaattcagaaacagattgttttgagggctttttagtatcatttacatatggatatcgataatcaagttggtgtttaatttgtgctttaacatcttcattaccattttgcatagtttctaattgattaaccgaacgatattcatcattatctaaaatggtttctgtagacacatcttcaaagtacacaattgaaatatttacattcggacgactactatcttcaatttgtgctatatctttttcaaattttaaatcatctggaattgacgcagattgatgtttagataaaatactataaataagatggaacggatttggtgaagttaatcgttcattgacagcaatgtgctcaccagaaatagacaattgctctagttctagtaatgatttatcatttttcactctaccaattaaataaagttgttctttcgctcttgttaatgctacatagactaatcgcatttcttctgacacaagttctttttcggcaacagctctatatgcaaccgaagctaaagatggaaatgccatttctttatccacatcaaaataatccattccgagaccaaattgctgatttaaaataactggttgtttcaaatcacgtttattaaaatcttttgacaatccagaataaatgacaaatggaaactctagacctttactactatgaattgtcatcattctaacgacattatcgtttggaccaactacattttcctcaccaaaatctttgcctctttcaatcaattcatcgataaaacgaataaattgatataaacctctaaaacttgaattctcaaactcgatagctttattaaataaaccataaagatttgcacgtcgtccacgtccaccaataagtccactaaagtattgaataacataatgatc

SEQ ID NO: 92 - DNA, 2792 bp, Staphylococcus aureus
gatcaacttaatataatgaattcggcaacagaagagcatcatcataaagattatattaaactatataatttaggtggcggtgctgctaaaaaaattgcaatagaggttttattggggaaggataaagtcattcagaaaaaatacgtgcatattttacctagtaaagaagggtacatgttaccaattaataaaaatgtgtacgaagaattagaaagaacgattgagaacaatggtcatgaagctgatttgaatgtacgtatgacttattatcataatgtaagtcgcaaacaacaggaagttatattaaaaggtcaaatcgaccgttttaatacttataataataaagaaatttatgatttgcagtttatctaaaaattgatttaagagggtagttgtttattgcgaaaaatatcattcaattttaatgaaataatggcgtcattactataaaatattactttatgttgtaatgcatttttctataagatagaactaaaaggaggggcaaagatgcaaattagacaaatacatcaacatgactttgctcaagtggaccagttaattagaacggcatttgaaaatagtgaacatggttatggtaatgaatcagagctagtagaccaaattcgtctaagtgatacgtatgacaataccttagaattagtagctgttcttcaaaatgaagttgtagggcacggtttactaagtgaagtttatcttgataacgaggcacaacgggaaattggattagtgttagcacctgtatctgttgatattcatcatcaaaataaaggtattgggaagcgattgattcaagcattagaacgagaagcaatattaaaaggatataattttatcagtgtattaggatggccgacgtattatgccaatctaggatatcaacgcgcaagtatgtacgacatttatccaccatatgatggtataccagacgaagcgtttttaattaaagaattaaaagtgaacagtttagcgggaaaaacaggtaccataaattacacatctgcttttgaaaaaatatgatttcaagctaggattacattaggtagagttcatattaataataaaaaatgtttgcaatcaaatcgtacgttgtcgtttgtaattcttaaaatagcaataaataaaatgtttgttagtaaagtattattgtggataataaaatatcgatacaaattaattgctataatgcaattttagtgtataattccattaacagagattaaatatatctttaaagggtatatagttaatataaaatgactttttaaaaagagggaataaaatgaatatgaagaaaaaagaaaaacacgcaattcggaaaaaatcgattggcgtggcttcagtgcttgtaggtacgttaatcggttttggactactcagcagtaaagaagcagatgcaagtgaaaatagtgttacgcaatctgatagcgcaagtaacgaaagcaaaagtaatgattcaagtagcgttagtgctgcacctaaaacagacgacacaaacgtgagtgatactaaaacatcgtcaaacactaataatggcgaaacgagtgtggcgcaaaatccagcacaacaggaaacgacacaatcatcatcaacaaatgcaactacggaagaaacgccggtaactggtgaagctactactacgacaacgaatcaagctaatacaccggcaacaactcaatcaagcaatacaaatgcggaggaattagtgaatcaaacaagtaatgaaacgacttctaatgatactaatacagtatcatctgtaaattcacctcaaaattctacaaatgcggaaaatgtttcaacaacgcaagatacttcaactgaagcaacaccttcaaacaatgaatcagctccacagagtacagatgcaagtaataaagatgtagttaatcaagcggttaatacaagtgcgcctagaatgagagcatttagtttagcggcagtagctgcagatgcaccggcagctggcacagatattacgaatcagttgacgaatgtgacagttggtattgactctggtacgactgtgtatccgcaccaagcaggttatgtcaaactgaattatggtttttcagtgcctaattctgctgttaaaggtgacacattcaaaataactgtacctaaagaattaaacttaaatggtgtaacttcaactgctaaagtgccaccaattatggctggagatcaagtattggcaaatggtgtaatcgatagtgatggtaatgttatttatacatttacagactatgtaaatactaaagatgatgtaaaagcaactttgaccatgcccgcttatattgaccctgaaaatgttaaaaagacaggtaatgtgacattggctactggcataggtagtacaacagcaaacaaaacagtattagtagattatgaaaaatatggtaagttttataacttatctattaaaggtacaattgaccaaatcgataaaacaaataatacgtatcgtcagacaatttatgtcaatccaagtggagataacgttattgcgccggttttaacaggtaatttaaaaccaaatacggatagtaatgcattaatagatcagcaaaatacaagtattaaagtatataaagtagataatgcagctgatttatctgaaagttactttgtgaatccagaaaactttgaggatgtcactaatagtgtgaatattacattcccaaatccaaatcaatataaagtagagtttaatacgcctgatgatcaaattacaacaccgtatatagtagttgttaatggtcatattgatc

SEQ ID NO: 93 - DNA, 2394 bp, Staphylococcus aureus
gatcagatttattagacagtattccagatatacccacaccaaagccagaaaagacgttaacacttggtaaaggtaatggattgttaagtggattattaaatgctgatggtaatgtatctttgcctaaagcgggggaaacgataaaagaacattggttgccgatatctgtaattgttggtgcaatgggtgtactaatgatttggttatcacgacgcaataagttgaaaaataaagcataattatattgggggaagagcatctatatatttttttaagtatataagacgtcttatttccccttaatttattgtgaagtatatgcaaaatgcaatgaatagattgtccatcattttaacgttataatgaatttaacgacttagaactacacaagtaaaggagaatgaagatgtctcgaaaaacggcgctattagttttggatatgcaagaaggtatagcgagtagtgtacctagaataaaaaatattattaaagcgaatcagagagcaattgaagcagcaagacaacatcgaataccagtcattttcatacgtttagtgttagataagcattttaatgatgtctcctcgagtaataaagtgttttcaacaattaaagctcaaggatatgcgattactgaagcagatgcatctacacgaatacttgaagatttagcaccactagaagatgagccgattatttctaagcgacgctttagcgcatttacaggtagttacttggaagtttatttacgtgcaaatgatattaatcatttagtattaacgggtgtctctacaagtggagctgtattgagcacggcattagaaagtgtagataaagactattatattactgttttagaagatgctgttggtgatagatcagatgataaacatgactttattattgaacaaattttatcacgctcatgtgacattgaatccgtagagtcatggaaaagtagtttatagttaatataacgtcaattaaagctcggcagtaatgtttgagaataagtacatttgctcatatttataaaatgtgtgagatggcaattgaaacggatatgatgaggaacatttgaacataaaataatatatttatataaaacgacccgaggcgttcgaactgaatgcctcgggtttaattgaataagaaatcggacttatgaacagaaatatgtttaagtccgaactccttgtttatacttataaattttacgggtttaatataatacttatttacctgtaatatatgataattcttcagcggcagctgcgttgatagttctatgagaaatgatacctaatcctttaacattggattctgaaataacgatagaaccatcactgttaactttttcaacaaatgctacatgaccgtaatgttgatctgcaccaaattgtccagcctcaaatacaacagcagcatgacgttttggtgtatgacttacttgataatcacggtattgagctcgattattccaattatgtgcatcacctaaatcacctgagatagatgtaccaaattgtttcatacggttatatacgtaccaagtacattggccatgtggatatggcatactatcagatacctcacggaaaggtttgaattcatctgatgaatcatcataatccttgatagaacgttcatatttatctaaatctggcatgcgttcatcgtcaaactgagttaattgatagtgtttaataatactgtttaatttcttagcatagtttggatctgtagcatatgttttagataagtgtgatgttgcatctttataagaatcggcttccgatttccatgttggtttataaattgttcgattgccatcaataccatttttaataaggtcagagtaatcttttagtgattctttcgtgcttggatattttcggaatccagcattaatactatacaattgattaccatcagcttctaatgtgttaaaaggaacagaattcccttcaaaagcacctttgataccgaataaattatggtttggtgacttagctaaagcactacgacctgagtcagattctaagattgcttgggcaatcatgacagacgcataaatatcgttatcttgaccaatgcgatgtgcatctttagcaattgatttgacaaattgacgtgtatcttttgagtcaacaacgttaaattgtccgctatcatcattgttagatatactaggatctgtttcgaataatgatgttgcacgtgtatccttttgattaacatcgttattgaatgattgagcaggtttagatttatgtttcaattcatcttgtgttggtaactgtggattctttgtattagatttttcatttttgtcttttttagattgagatgcataatctttttgtgttttctttgcatcttcactgtattgatc

SEQ ID NO: 94 - DNA, 853 bp, Staphylococcus aureus
tggatcattatataatgctggataatcatcgttatattctaaggtgcaagttacaccatacatatcctctaatccttttgataaacgtttaatttctttttcaattgttgcttttgtagcatctgttaatccacgtacatcaccttcaatttcaacaacatctttaatgacattgaattgacctttaccgtcaaatgaaccgattgtgacaacaccggtttcaaatggacttagtcgtctagatacaactgtttgtaacgctgtgacgaagtagctacctgcaacaatggcatcattggccatatgtggtgatgaaccatgaccacctttaccttgaactttcaatttgaagaatgcgcgtcctgtttgaacataaccaggtctgtaatacactttacctgttttcattgtgctcatgacgtgtacacctaatacatgatcaacaccgtctaatacaccattttcaatcattgttttagcaccacctggtggtacttcttcagctggttgatgtatcacaacgacttttcctgtaaaactatctttcatttcagcaagcgtctctgctaatacaagcatgtatgctgtatgtgcatcgtgaccacatgcgtgcataacacctttattttgtgatgcaaaagataatcctgtatcttcagtaatgggtaatgcgtcaaagtctgcacggattgctaatgttttaccaggtttccctgaatcaatcgttactttaattccacgtggtccgacattcgtttctacttccacatctttacctttgtaaaattcagcgatgtatttcgccgtttcatcttcatgaaaagataattctggatgctgatgtaaataacgt

SEQ ID NO: 95 - DNA, 1164 bp, Staphylococcus aureus
cctgtgtaagcgtgaattgtagtcattaaaccttcaactaaaccaaagtcatcgtttaaaactttagcaactggtgctaatgagtttgtagtacatgaagcacctgaaacaactgtttcagaaccgtctaactcttggtggttagtgttgaatacgattgtttttaagtcaccagtagctggtgctgagattaatacttttttagcgcctgcttcaatatgagcttgtgctttatctttatcagtgtagaaaccagtacattctaatactacatcgatatttaagtctttccaaggtaatttgcttgcatctggttcactgaatgatttaacttctttaccatttacgcggaaaccaccatcaactacctctacttcacctgtgaaacgaccttgcatagtgtcatattttaataaatgcgctaacatgtcgtcatctgttaagtcgtttactgctacaacttcaagaccttctacttcttgaattcttctgaatgctaaacgaccaattctaccaaaaccattaattgctacttttactgccattataatggcctcctttaaaatgatatttaaaaagtattaaactttttatctcttattcaagtattatctttgctgcggcttcatcagtgattaacactgtattcttgggtgcaatcgtcaagtatgctttaattgcttcacctttcgatttgcctcctgcaactgcaaaaataaagtcttttgattcaaggtcttctaattgaagtccaattgttttaaccttatggacaatttgaccttgtgtatcaaaataataaccaaatgcctctccgacagcttgatgatgttgaagttgttcaatgaccttttcaggtgattgacgtcgatgcgccatcttcagcgcatcaccaatgccgtgtaatataacgtttgcttgtttaattttgtctaaagtgtttatgactgatggctctaacaacaatgtattatatgttgtttcactgacattatcaggtacatacatcgtcgtataataaccgccagcttgttgtgccatactggctgcaattgtgtttgcctgaaagacaacattttcgcctagtccacctctggctggtacgaagaatacattatatggtaataaatgaattgcttcactaacacatgccatcgtggatcc

SEQ ID NO: 96 - DNA, 2070 bp, Staphylococcus aureus; identical to SEQ ID NO: 91

SEQ ID NO: 97 - DNA, 4690 bp, Staphylococcus aureus
gatcctctaaagtgattgtcccaccacatgctttgacaacattgactaattgtttcgcaatgtcacctttataaaatgcattaaacccttgttctcttaatatttgaaatgtcttacctaattcgggttgtacaatccaatcaccttcacgccaatattgattttcatgcgtaaatacttgtgccgtttcatgatactttgtcaatcgtgcgtgttgctggcgcgaatatttttcagtagcccaattggctgcatgaccttcaatggctagttcaattgcaggattaattaaatcttccaatgacaatttagcataacgcttgtgaatataatcaaacagctttggaattgctggcacagcgacagttttaccatgtgtagtcatatcaaaaaatgatttatattcgcctgaatcatctagataaaattgtttgtctacatgttcaggtgctgtctcacgtgcatcaaacgcagttatactgccagtactttgctcataatatagcaaatacccgccaccaccaatacctgatgcaaatggttctaccacattcaatgccagttgaattgcaatcactgcatccatggcgttgccaccttgatctaatacatccttaccaattttagccgcaagaggatgtgatacggaaattaacccttctttagatgtttttgtctgtttgtcatttaagttaatgaccatactatatcctcctactttctgttaaatatttaaaacattattgattaatggctttttctactttttctaaatcttgacgttgctcgttaccagtatcgacaagtggtgtaatcggtgatgcaattttaaatttatcgccacgataaaacttaataaattgatcctgatctatcgcattaactactgcttgtctcaagtttggatgcgtcttaaatataccttttttaatatttagcattaaaaagactgacttgcgtccatttttgcgaataatgcttaaatttttatccgacttaattaaatcaaaatgtttttgattcacatctgccaacatatcaattgaatgatttctaagttctgacaatgcattattcgggtcaccattaaacttcaatgtaatatttttaattttagctggtccataactacctttttctgtttcgttgaatcctggattacgttgaaacgttgcttgatatgcatttttctgtgtcataatgtatgcgccacttgcatacagcgcatttttcccatctgaatttgcaggaattgtactgctatccccatatccttttggatattcttgatttacttgattaacaaattttttagataaaatgcctgccgaagagtgtgttaagtaatttacctctcgaggcatcgattgatctgtcgtaattttaacaatttgataaataccgtctttattatttactttttgaccatctgtcgttaacgatttgacgttataagctttaatcaacttatcatagattgatttatcgtccttgtctttctctttacgcaactgatcgatgtcctcatcttttaatatcttgatgtcatttatatgtttgtgcatattgtaagtattattgttaggcacagactttttatcacgtgctctatctaaagaaaacttaacatcttcagccgatacacgctctccagtattacgtgcttgtccattgaccactttcgcaaaataatcatcatctcttaacaagaaataaaatgctttattgtccttattcacagcataatcatgacttaacgaacctttcgttgttaaatgatcattttcatctaataataataaccttgtgtacatattcatattaattgaatatactgacggcgcaattgaacgtattggatccaatgtaggaatttcaccatcttgttgtgtcatcacaagtggccgcgtatctcgttctctactattgttgtaatcaaattgttgccatattaatgcacgtgaatttggcaatccaacactatttttatctaacactttattgtcatatactaaattcttttttgatccatataaaggcgccatataccctttatcaaatacaacttcatcttcaatttgcttatatgtttgtttaacatctgcttcattttgagtagaagctttatttaacaactggtctacatgtttatctttcaataaactatttgatcctgtagaactaaataatgccgtcatagcatagttcgggtcaccaaacactgtcatccagtcatcaatttggatatcataattgccggcttgacgttgtgtacgatagctaccataatctggttggatattcatcttcacgttaaatcctgcattttccaattgatctttaacgatattcatatcattttcataacttgcttgtcctaggaaatgtattgttggtcgctcgcctttcacttcaactttcgatgacttttgagccacttctgatttcgtagggacaccacaaccacttaataccaacgctaaaactataattgcgatactaatgattttcttcacatctatccctacctttttaatgaattcttggatctagtgcatcacgcactgcatcacctataaaattaaatgctaaaacgacgaacataatacaaacaccaggtacaatagctaaattactgtgcgtttccaagtagttactaccggtacgtaaaatgttgccccattcagctacatcaggtgcaacaccaagtcctaggaaacttaaactacttgttgttaatacaaccacacctatatttaatgaaaaacgtacaatcataggcgcaatcgcattcggtaaaatataacgccatatgatattccaagtgttttcaccagtgatacgtgctgcatctacatattccatgcgtttaatttctaaaacactggcacgcattgtccgtgcaaatgatggtatattaccgatacttaaagcaataattaaatttggaatacttgctccaaatgatgcaataattgccaccgctaacaataatgatggaattgcaaacactacatctaaaattcgcattattaaattatcaatatgattaaaataacctgcgatagtgcctagtaacacaccaaaaataactgcaataactactgaaataattgaaattgaaaatgtcagcttcgttcctacaactacgcgtgtaaataagtctctaccgaaatcatcagtaccaaacggataggctagactcggtccatgtaacagtgcattgaactgatttttagtagccaatgtcgtatcaaatgtaaattgtgacacaattgataatgtcagcatgtagactaaaataagtaacccgataatcgcaatacgatgtctagtagtttttcgtataaacgattcccacccgttataactatgtatttgcgatgtacgttggtaacgtctaatacttacaaacattaataatgtaaatacgttgcctgttaatgtcatcaacaataacaacacttcgacgatacgtcgccataggtcatgatgcttccatgtttgttccgttgttaaaataataattaaaatgatggttaaaacgattagcaatgtttcagcaatatagaacgtatcggccacataacctttaaaaagatttaatgcactcgttaatataactaaaatataagttgctatggcgtaacttgcgaataattttaaggaagctatctttgaattaagttgtgccatatgcctcacttcctttcgttgatttcactacgtaattttggatcgattaaagcataaaatatatcaataattaagtttgctaaagatattacaattgatatatatacgaccccacccatgactgctggaatatcaggtattagttgtttttggacgatataacgcccgataccattaatgttaaatacttgttccgtcactgctgaaccgcctagtaactctgccactagaagaccaactaacgttacaattggaataatggcatttttcaaaatatgtttaataacaacttgtgtcgtcgataatccttttgcataagcagttaaaacataatcgctgcgcattacttcaagtacagaagaccttgtcatacgcgtgatagaagcagcaatacttgttccaatgacaagtacaggtaaaatcaacgatattggatgttctggcatataagatggtggcaaaatatccaatttcaatgagaacgctaaaatgaataatagcccttgccagaaacttggaatagataaaccaattaatgcaattatcattaacgtgatatcaagccaactatttcgcttcatcgcactgataataccaattggtattgcaataattaatgccaccattagcgctaatactgcgacaattattgtaattggaattctttcgccaactgctttagtcacaacctcattccctttgtaagtcgtacctaagtcaaaggtaaaaacacccttgatggtatcccacaattgaataaaataaggttcgttaagatgatgtaatacattgaattgatgtatctgtgcctttgttgcattttgtcccagtatgctataagccgcatcaagcggtgaaaaatacagaatggtaaacacactgacaataacaccaatgatgacaatcacagccatgacaattcgttcaaaaatatatctaactaatggctgtaaataaaaagtcaataagatgaacatcggcaaggccaatatca

SEQ ID NO: 98 - DNA, 1430 bp, Staphylococcus aureus
acggattgctgtattgagttggttatcattatgtatatgtatcgctttagcgctcatattatatgcattaccatatctcattctcggtagcaataattggtcttttgtactgacttggctaccaatagaaattaaattagcactaatcacaacattaattgcattattcagtacattaattgtaattctgttattccttcatacaaagataacgaagacataataaaaaagacttgttcgagccgtgcgtttgataatatatcatccacgattcgaccaagtctttattctttgtatattaaacggataaattattatttaattggattcatgccatctttccaagtttgataaatcagagtaccaccttgcgctttaaacttctcattgcttacgccacgttcaaatggttgcgcaggttgaatatcaatatttggttcaacaccaagttgttctttataccattctgcaaattcagaacctttaacaggtgcatcatctgctacattatagataccattttcaaaatgaatagcttgaatagatgtttcaactgcatcatcaagatgcacaaatgatgttacgccatctgaaagtgtcacttgaccatccataaattgattataaatcatgccatcttttccgtaccaagtacctgggccatataaccagccaaaacgtaaaacaacgtattcatccatacgagccgtttcttcttctaaaccaaccacaccatcaaccgttacttttctatcgccagttgagttaaaatcaagtgaagtttcctcatttgctaatccttcgccaggttcatacataaaggcaatactttgggcaattactttcttaacgtcatgctttttcgccgcatcaattaggtttttagaaccttcaatacgtactttcgtatttgctgccatatcaacattttttaaatccgtaatttgattgataatgatttctggtttaaaatctgctaacgcttgatcaatagtatcagcttttaatatatcaccaatatatgcttttacattaacagcagctagcttttgttgaccattctcagatgtagtaaaaccagcaacctcatgcccctcttcttttagtctttgaactaatttaatgccaataaggcccgttgcaccagttacaaaaattttactcattataaacaccttttctctatttgtctttttaatataattacttgcttgatgagtttacaaaattcacgtgagacttccaaatgatttgcctcaaaatttttcaaagtgtcgtcgtaaaaactgtctagtaaatactaatagtatgtcgtagacctatgacaaatctgaattatgacgaagatcaatcaagaaaaacagcaccaagatcatttcaatttgaaagtaccttactgctgttctttatttattacatttcaatcttaa

SEQ ID NO: 99 - DNA, 1164 bp, Staphylococcus aureus; identical to SEQ ID NO: 95

SEQ ID NO: 100 - DNA, 1001 bp, Staphylococcus aureus
ggctatctatcaaaataaagatggtcatttaaagcgtacacttcgggtgcgtgatttcttagctttaggtgtaggaacaattgtatcgacatctatctttacgctacctggcattgttgctgcagaacatgcaggaccggccgttgcgttatcattcttactcgctgctattgttgctggtttagttgcatttacttatgcagaaatggctgccgctatgccatttgcaggttcagcctattcttgggtcaatgtattatttggtgaattttttggatgggttgccggttgggctctattagctgaatattttatcgccgtagcctttgttgcatcaggattctcagcgaatttacgcggacttgtgaaaccaattggcatcgaattacctgcagcattatcaaatccatttggtacaaatggcggttttatcgatattattgctgctatcgttattttattaactgcattattactatcacgtggtatgtcggaagcagctcgtatggaaaatattttagttattttaaaagtattagctattattttatttgtcatcgtaggtttaacagcaataaatgttagtaactatgtgccatttattccagaacacaaagtaactgctacaggtgactttggtggatggcaaggcatatatgctggtgtttcaatgattttcttagcgtatatcggtttcgattctatcgcagcaaactcagcagaagcacttgatcctcaaaagacaatgcctagaggtattcttggttctttaagcgttgctatcgtattatttattgctgtagcacttgtgttagttggtatgttccattactcacaatacgcaaacaatgctgaacctgttggttgggctttacgtcaaagtggtcatggtgttgtagcagctattgttcaagctatctctgttatcggtatgtttacagcattaattggtatgatgttagcaggctcacgtttactttattcatttggacgtgacggct

SEQ ID NO: 101 - DNA, 393 bp, Staphylococcus aureus
gatcaaaattaggcttgtttgctaattttaccgcattaccatgttcgctttcgcggttcgcaaaaccatctaaaataattaacgcagttggtttcttagccatgattattttgcaccttctaacaattgtacgaaatcttcaactttaagtgatgcgccacctactaatgccccatcaatatcagtttgtgccatgtattctttaatgttgttaggtttaacactaccaccatattgaatacgagttgcttctgatacttctttgcttgataagtcagcaatagtttgacgtacaaatgcacacatttcatttgcatcttcagatgttgatgatttaccagttccgattgcccagattggttcataagcaattacaactgatttaagttgatc

SEQ ID NO: 102 - DNA, 2467 bp, Staphylococcus aureus
gatcttaaactttatctttagctttttagcttcaatgttcttctgcgtcatttttgatgcacctagaaaattatatctatcatgtggtttcgttggtacgtgtggatggatggtttacaccttattcttcaacggctttaatgtgcacactatatactctagtttctttggtagtttagcattaggcttgttaagtcattatatggctcgtaaacaaaaagaacctgccatcatttttatggtaacgggtatcattccattagtacctggtggcttagcatacgatgctacaaaaaatttagtcttattaaatttcagtacagcaatcaataccatgctagaggttacacttattgcaggcgccatcgcattaggtttattattcgccgaccaaatttccaaattaattgtttctgggttcgtgaaatcttttaaacgattataaatatttgttagaaatggctcagccctaactcttagcaattatatataaggttcagctgcctcgtcttaaatgtcaatttataatacaaaaaatcgcacgatacgcctccgaatgaagaaggtttattgtgcgattcttttattatttagttttttctttttcaggttcttcaatcatatcatcaacttcattttcacttctatttaaaatcaagcgacttaattcatcattatccatatttttcaatttaggatatcgaatcacaaagaatattaaaccgatgattaaccatccaagtaatgcaatataagacggtgcagtcagtgctgcaggagaacctggcactaataacaacgctaagaaaatgaatgatacaaatgagccgataatagcaaacgttttgtaaaccggtgcatacgtattactttgtttgttataactgaataatttcgctgcagacaaacatgtaataaagtaggcaatggatacaccagtagatgacatatctacaatccaagtcaatgcagttcttcctagccaaggtgcaattaacgacactcctactaggaatatgattgcgacatatggtgttttgtatttactatgtaatttactaaacattgttggcataatacctgaacgtcccatagaaaataacaagcgacttgaactcatcaagaatccatttaaaccagtaaatatacccatcataattgcaattgctaatacacctaatccaatataaccaaatgctgtttgtgtaacagcacctgttaaccacaactgcccatttaaactttgatgacttgttgataaccaaccagtgtataaaatcatgacaacataagttaatgatgctgctaataaactgtacacgataagcttaaatgtcttgtttggtgcaaagttaaactcttctgctgtttgtggaatattatcaaatccaacatatgcccatggtgccacggatacaataaccacaatagacactaaccatcctttgctaggttcagctaacggttgtaaattttcaagtgcaaaattattaccaaagaatgaaccaaagaacatcaataatacgacgattaccatcgccacacagaaataatattgtaatgatccagatacacttgcgccacgaatcgttactagcatgaatacaagtagtaatacggtcgcaataatgatttccgtaatataaacgtcccagcccgcaatggtgtatagtttcccattatttaagacatctggcaataagaatttaactagtaaactgaatgcggtcgcatttaaagcaacgacacagacataaccaaaagttaaaaaccatgatgagaagaaactcacatatctgccgaaacttaagaaactaaaggcaaacgcgccccctgatactggaaatctctctactaatgcgccataactaaccgcaattaatatcattaataatgcaccaataactataccaattgatgctgcaatcggacctgactgcttaatccagtctcctggtaagatgaatgcgccccatccgatacatgaaccatatgcaatcgcccatacaaacttttcagataggttttgttttaaatcgcctctatctatttgcttattctttttttccataaataaaaactcacctcgaaggtattctatacccaaaagatgagtttgtaactctttttcttgattatttttattaaaaatttaatgtttagttacataggtaatctaaagttttaaaatttaaccagcaaatttgaatgtcgcaatgattaacattatccatccaatgatgaacaatacgccaccaattggcgtaatcgcacctaaaactttaatttgagttaatactaaaatatataatgatccactaaagaaaataataccagcaaatattaaccagccagcccagttaacattgattgaagttgtaccactaattacacctataattaataatgctaagccatggtacatttgatacgtcgttgctttttcccatactgataaatagtgatc

SEQ ID NO: 103 - DNA, 193 bp, Staphylococcus aureus
gatccaacattacgacgcgtgatgaacgaaatagataaaaagccagagttaagagagcgatttattacatcagatgatgcttgggatatgatgacatctaagacaaccgtagtgattgttgatacgcataaaccggaactggttttagatgaaaatgtcttaaataaagcaaaccgtaaagttgttatcgatc

SEQ ID NO: 104 - DNA, 3173 bp, Staphylococcus aureus
gatcggaattccgtttgctgcgggcttgattaattttgtagtattaaccgctgctgcttcatcatgtaacagtggtatattctcaaatagccgtatgcttttcggtttatcaagtcaacaacaagcacctccgaacttttctaagacgaataaatatggcgttccacatgttgcaatctttgcttcatcagcattattacttgtggcagcattactaaactatattttcccagatgcgacaaaagtatttacgtatgtgactaccatctctacagtgttatttttagttgtatggggtctgattatcattgcatatatcaattatagtcgtaaaaacccagatctacataaaaatgctacgtacaaactattaggtggcaaatatatgggctacttaatatttgtattcttcatttttgtgttcgggttattatttattaatgttgatacaagacgtgcaatttattttattccgatttggtttatacttttagcatttatgtacttaagatataaacgtatcgctgctaaatcaaataaataacaacaagttttagggcttgggacattaagttcttaggcaatgtaaaaaagctgatttctattaattatttgatagaaatcagcttttttgatatgtattttataatgtacagctcgttgagctgctattttccttatattaagtgccatcaatacaaaacctagctctcgtttaactttatttattcctcgaactgacattcgagtgaaacccaaaatagccttcataaatccaaaagcaggctctacatcaatttttctttgactatagatgtttttcgtttctggttcagaaagcttttgattaatttggactttaaagtattcccaattataattcttcatgattttcttattggatttcgaatttggtttcatgcattgatgtctcaaagaacatgatgaacagtcatcacattcatatagtttgaagtctcgtttaaaaccatatctatcattacggtatgcatatcttttaaaacctattcttttgttattaggacatataaattcattattaagttcgtcatatttccaattttgagtgttgaaaatgccacttttaaactttctagttttatctttaataaacatgccatacgtaataagtggcgttttattaaaatcatctataatagccatatagttttgctcactaccataacctgcatcagctacaatatactctggtaaataaccgaaggtattttgaatcattgttaaaaatgggattaatgttctagtatctgttgggttttgaaataggtcataggataaaacaaattgagaatttgtcgctatttgtaaattgtatcctggcttaagttggccatttttcatatggtcttccttcattctcataaaagttgcatcatgatcagatcagttttagaaaaactatttctatctttaagaatcgatttttgttcttcatatttattttttctttcggaataatcatcaaatttctttttgaacttcttaatctcagttatttttttacgggtctgttttctaatttgagcacaatcttcgttctcaatagaatgatttaaatcttcgatttctttatctaaatgactaccaattaaatctatttcttctattgttaaatcgctatctccatcttcttttatctctggtattattttttcttcaactaagtcacgatataatgtttttgaattttcgttcaatttcgattcgtgattttgaatacttttcttccacacaaatgtatatctattggcattagcttctacttttgtaccatcaataaaaattgaattattatcaataagattttgctttaaacattgactatggaactgaataaataaagattcaattaacgcatcagtattaggattcactctaaaacgattaatagttttataagaaggtgtttgatcttgagctaaccacatcattcgaatactgtcatgaagtaatttttctattctacgaccagaaaatacagattgagtatatgcatataagatgatttttaacatcatttttggatgataggatgttgcgccacgatgatgtctgaattcatcgaattcgctatcaggtatcgtttcaacaatttcattaacatatcgcgaaatatcattttgaggaattctaacagaggtttctattggtagtgtaagttgggtcatgttataaattttatacataaggcacctcgttaatttagtttagtggtatttattaaattatacgaagggacccaacacagaaaattcattttattgaattttacatttatgtgcaagttgggcaaagtgttttatttttttaaagtatgtaaaagtaaaattacatgttaatacgtagtattaatggcgagactcctgagggagcagtgccagtcgaagaccgaggctgagacggcaccctaggaaagcgaagccattcaatacgaagtattgtataaatagagaacagcagtaagatattttctaattgaaaattatcttactgctgtttttttagggatttatgtcccatcctgttttatatgcaacttataatattaaattgcgtacttggctcaaaacttttactttctcatctatttaataatgtatcatttcagaaatacatccatacttctattttataataaatttccaaagtaatatgagtgaaagtttgaaggtgataatgtacatgtataaaagatataaacatttatatagattgccattcatacactatcattatcaaataacctattaattacgtcataaaataccagatgaaccaaaaaacgcctttccattgttgataaatggaaagacgtttttttataaattatagtacgtttgcatatccttcaaagattttaccttgagcagcatcaatcgtaactaacatgttattgcttatgtttttaacagctttttctacacctacaactgttggaatacctttttctaaaccaacaattgcacttggtgatgtaataccattttcttctgtaattaagcctaaagctttttctacataaggtacaaacgtttcatcgattgagttagtaacgataactttgtcagataaatctttaccttctaaatctttaacagtttcagcaactaacgtagtaccaacaactgatc

SEQ ID NO: 105 - DNA, 2582 bp, Staphylococcus aureus; identical to SEQ ID NO: 35

SEQ ID NO: 106 - DNA, 1448 bp, Staphylococcus aureus
ttaatgatttctaacaatcttaatgttgctacgacgtttatttcttgagataagataggtttctcaaccgactcagcaacactaactaatgctgctaaatgaataacataatcaaattgatatgtcttcatgatttgttcaactgcatcatattcacgaatatctaattcaaacacatgatcgtcagccaaacttttaatattttctcgtttacctgttctatagttatctagaacataaacatcataatcttgttgtaaatcatctactaaatgcgacccaataaaaccagccccaccagttatcaaaactctttccaaatcttccacctcatttatacattaaaaatatatcataaaaacataaagtattgtaagctttttatcgatattttttatttataaaaataaaatgagataactttgtgaatttttattgagataaattagatagtggtgtttttgtgatgttttataatatcttgggtgtgttaatactaataatgctttcaactgatgcattagactgtgacatcataactcacttaagaacttcgcttattaattttctaccaatacactcccttctaagtgcactaaaaaatccttactgctaagtgattaaacttaacaataaggatttatttatcattagtggatgattattaacggaatctcataccaccatctacaataattgtttgtccagtaatgtaatcagagtctttaccagctaagaagctcactacatttgaaacatcttctggttgagaaactctgcccaaagcaatctgacttgtaaattgttcccaaccccatgcttcaggtttacctgcttcttcggctgttgccactgcgatactttccatcattggtgtttgaacgataccaggtgcgaatgcattcacagtaataccttcagacgctaaatcttgtgcggctacttgtgttaaacctcgcactgcgaattttgtactgcaatataaagacaagcctgggttaccctcaacgcctgcttgagatgttgcattgataattttaccgccatgattgaattttttaaattgttcatgtgcggcttgaataccccatagcacacctgcaacgttcacgccatatactgttttaaactgttcttcagtaattgtatcgattggtgttgttggtccaaggccggcattgttaaccatgacatggaaatcgccaaattgcgcggcagtttgtcttactgcgttaaatacatcatcacggtttgatacatctgctttgatagcaatagcttttgtaccatcacttgataatttaagtgcagctgcttttgccccttcttcattgaaatcaacaactgctactttgaaaccatcttccactaaacgttctgcaattttaaaaccaatcccttgtgctccgccagttactaatgctactttgttgtttgtcataaagatc

SEQ ID NO: 107 - DNA, 1927 bp, Staphylococcus aureus
gatctacttctacaactttaggcatgtctgctaagtgaacactttcttctttaacatgtggtgtatgagaccaaacttcttcagctgtatgcactaagattggtgctaacaacttcgtcatatcaactaaaatttgatataacactgtttgcatactacgacggatatgagaatcacgttgttcaatatataaaatatctttaccgtaatccaaatagaaattacttaactcaacattgataaagttttgaacttcttgataaatatttaagtagtcaaagttttcatagttgttaatcgtacttgcagtaaattcacgtaaacgatttagcaagtaacgatccacttctaataactctgattcaggaatgctatctgtgtcaggattgaaatcgttaatgttacctaacataaatcttaatgtatttctgattttacgataaacatcagatgtttgttttaaaatttcatcagaaattctaacatcagctaaatagtccgtactacttacccaaagtctcgcaatatcagcacctttttgtttaaccacttggtcaggtacaatcacattacctaaagatttactcattttcttaccttcaccgtccataacaaaaccatgagaaagtaagaatttataaggtgatactcctcttgtagcaactgaagttgtgatagaagagttgaaccaaccacgatattggtcactaccttctaaatacatatccgctgggaaacttaattccggtcttgtttccaacacgccacggtgtgatgaaccagaatcaaaccaaacgtccataatgtctgtttctttagtaaatgtaccgttagggctgcctggatgtgtaaatccttctggtagtaagtctttcgcttctctttcaaaccaaatatttgaaccgtgttctgcaaataaatcagcaacatgattcactgtttctttcgtcatgataatttcgccattttcagcataaaatactggtaacggtacaccccacacacgttgacgagaaataacccattcgccacggtcacgaaccatattgtaaatacgtgttttaccccaatttactttgaagtttgtattttcgattgcatctaaaatatcttgtcttactttactgattgaggcaaaccattgtggtgtagcacggaagattacaggtttttttgttctccagtcgtgtggatagctatgtgtaataaagtctaattttaatagtgcacctttttctgttaataaatcagtaacggctttattagctttatcatagaacatcccttcaaattggccgccttcttcagtaaatacacctttatcatcgattggactaattactggcaattcatatttttgaccaacaatatagtcatcttccccgtgacctggtgctgtatgtacacaacctgtaccagcatctgtagtaacatgatcaccattaatcactaacgattctctgtctaagaatggatgttgtgctacaacatactctaattctttacctgtgtattctttttctaatttgattgatgctttatcccaatccagtgcttctgctacagcgtcagacaaggcttctgcaataatatatttttcgccatttacattgtattgaccatattttaattcaggatgaacggtaatcgcaacatttgatggaattgtccatggcgttgttgtccagataataaatttagcatctgcatcaacgacacctttgtcatctttaacgtcaaatgcaacgtaaattgatgctgaacgtttatcgtgatattcaatttctgcttctgctaatgaagactcacttgaaggagaccaataaactggctttttacctttataaattaaacctttatctgccatttctccaaaaatacgaatttgtgcagcttcgtattcaggttttaatgtaatatatggatc

SEQ ID NO: 108 - DNA, 1400 bp, Staphylococcus aureus
gatcaagttcaaggttcattagaaattatttatagtttgcaagaagaattaaaagaaattactggtatggatgaggtgacattacaaccagctgctggcgcacatggtgaatggactgcattgatgatatttaaagcttaccatgagaataatggtgaaggtcatcgtgatgaagtcattgtgccagattctgcgcatggtacgaatccagcctcagcttcatttgcaggatttaaatcagttactgtaaaatcaaacgaacgtggcgaagttgatattgatgacttgaaacgtgttgtaaatgaaaatacagcagctattatgttaactaatccaaacactttaggtattttcgaaaaaaatattatggaaatccgtgaaatcgtccataatgctggtggtctattatattatgatggtgcgaatttaaacgctattatggacaaagttcgcccaggagatatgggatttgatgctgttcatttaaacttgcataaaacatttactggtccacatggtggtggcggtcctggttcaggtccagtcggtgtagtaaaagaactagcaagttacttaccaaagccaatggttattaaagatggcgacaaatttaaatatgataatgacattaaaaattctatcggacgtgtaaaaccattttatggtaactttggtatttacttaagagcttatacgtatattcgaactatgggagcaactggacttaaagaggtttctgaagcagcggttcttaatgcgaattatattaaagcacgtttatctaaacactttgaaataccttataaacaatattgtaaacacgagtttgtgttaagtggtgtgcgtcaaaaagaatttggtgtacgtactttagacatggctaagcgattattagatttcggtgtacatccaccaacaatatacttcccattaaatgttgaagaaggtatgatgattgaaccgactgagacagagtctaaagaaacacttgattattttatcgatacattaattagtattgctgaagaagctaaaaatgatcctgataaagtgctagaagcaccacatacaactgtgattgatcgattagacgaagctacagctgctcgtaaaccaatattaaagtttgaaaatcttaaacaggaaaaataaagtattaaacacatattccgagaattattattctaactttgtatgaagatttaaggataatggtttcaaaatcaattgaaaaagacaatttctatttaaacaagaaaactaaaccgaagtaataactcttagggtttggtattattctttcatagaaattgtcttttcattttttagattgcggtaattgaatcgtattgaaaatgagctgaactttctttattatgctgaaactaagtttaatgatc

SEQ ID NO: 109 - DNA, 1690 bp, Staphylococcus aureus
gatcctgtgttaactggtcgttaaaagtgactttcgtttcagtgtaaaatttttctaatgtaacagatatgctattattcattggaatgattagtgcttcatcttttttaccccaatattttataagtgcaatattcgtatgtgcacgtgctttgccacttttaatcaacgcattaacctcctaaattctcaatccaagtatgtgctgcaccagctttttctacagcttttacaatatttttcgctgttggtaaatctttggcaagcaataacatacttccaccacgaccagcgccagtaagttttccagcaatcgcaccattttctttaccaattttcattaattgttctattttatcatgactaactgtcaacgcctttaaatccgcatgacattcattaaaaatatccgctaaggcttcaaagttatgatgttcaatcacatcactcgcacgtaaaactaacttaccgatatgttttacatgtgacatgtactgagggtcctcacaaagtttatgaacatcttctactgcttgtcttgttgaacctttcacaccagtatctataacaaccatatagccgtctaaacttaacgttttcaacgtttcagcatgacctttttggaaccaaactggtttgcctgatacaatcgtttgcgtatcaataccacttggtttaccatgtgcaatttgctctgcccaattagccttttcaatgagttcttctttcgttaatgatttccctaaaaaatcataacttgcacgaacaaaagcaaccgcgacagctgcactcgatcctaatccacgtgatggtggtaaattcgtttggatcgttactgctagcggctctgtaatattatttaattctacaaaacggttcaccaaagacttaagatggtcaggcgcatcatataacataccatcgtaaacatcgcttttaatagacgaatagttcccgctctctaaggcttctattaaaactttgattttacctgcgttaaacggtactgcaatagcaggctctccaaatgtaacagcatgttctcctattaaaataatcttacctgtcgattccccatatccttttcttgtcatgtcaatatcaccttttatatttatcctatacttgattcattatttttatttattagtaaaagacatcatattctaagttgcatacgcattcgcgttaaatttcattgcagtctttatctcacattattcatattatgtataatctttattttgaatttatatttgacttaacttgattagtataaaactaactttcgtttacttcaaagtttaaatcttatcgagtgatatttcagattctttatctttttataaaatagccctacaatttataattttccaccctaactataatactacaaataataattggaatatatagatttactactaaagtattagaacatttcaatagaaggtcgtttctttcatagtcatacgcattatatataccctattctcaatctatttaatacgtaaaacatgaaattttcttattaaatttattatttccatcatatcattacttttaatttaatgatgttcaatttaaatattaggtcaataacatatttatgctttttatggatactttcaaaaataacagccccaaacgataacttgaaaggggctgttaaatatttaactattgcatt

SEQ ID NO: 110 - DNA, 1480 bp, Staphylococcus aureus
gatcattcattttaaagccagactttttataatcttgtacaaatgcttgcgctacatccttgtgttgatcaagcaattcccctctcagtactagcacacagcaatacgcatcaggtataacgtcatcaccatgtttcaaagtcttacctttgcctaacttttcacccagtgcaccgaatggttcggctacagaataccctgtaattctgtgttcactcaatgcggctggcatttctgctggcgacatttcatgatagctaaaatgccccggtttaatctttaattgtttacgtaattcctcaagtaaaagataatgtgttgaataacgatgtggtataccaaaatggtaatcatcgccattattattaaattcatttaagtgcatacctttttgtcccataatgacattgccttcatgatggcccaatgccacagcctttatatttgagcccttctgttttgatttcatcgctagctctattaaagttgatgcaccatcaatacgaccactgtttaatgcgtccattaaatctggccaattattgaatttaactaattctagtttatatttcggatgattgtattgtgataataattttttagtcatcatcaaattagctgaatgtgtaatcggcaaatatccaattttaatcacttgctgattttgggcatttttagaccgttctttagacgtcctttgccaatcacatcctgtaattataaagattccaatgatgacgattatgcttaaccttttcatcgtcactcactccttataaataatattcaggttcaacttgatgatgattcaatgcaaatgtttccataatttcattacgaatcttaagtaggtggctatcattacgactgcgtggatgtgatgctgtaatttcatattgagaaataatattgcacccttcacctaacagaacaatgcggtcggaaagataaatagcttcatcaatgtcatgcgtcactaaaataatagttgattgcgttttatgttttagttgcactagttgatcctgaagtttataacgtgtaaatgcatctaatgcacctaatggctcatccatcaatataacgttaggcttatgcacatgcgctcgacatagtgccacacgttgtttcatacccccggacagttgctcgggaaaatgctttcccctgtcttctaaatcaactaatttaagctgtgcgttaatctcttcatcactaattttctgttgtaatccaatcctaatgttgtcattaatcgttttccatggcagcaaattatgatgttgaaatagcattaaacaatctggagatggctgttgtttaatttcgttatcaataatgacacgaccagacgatggatgaataaatccaccgataatattgagtaaagtagactttccgcaaccacttttccctatgaaagtgactatttctcccttgctaatgtccaaattaaagttatgaattactttatgtgatc

SEQ ID NO: 111 - DNA, 1331 bp, Staphylococcus aureus
gatcgccgataagtaaaaacggtgcattcatacgtttcatcatataatatccttcgaaaccttccgctgttcgataaccactaaaatatacgtttagtggcggtttcatatcaccagggtggaaataataaataaattcctgtcgttgactatctacgaaacgactaccaccaagtaaaaattgacccatgtctaatctagaccatcgtttgtgtataggtcctaaatgtaccgtcccgttcccacgcgccttaacagttacacttatataagcatcaaatggtttcgcaggtatctctaaaggactgtctaacatatcatcagtcaatacgatttgttcaattaatgcaccatcagcgccagtctgaatcaatctaaatgtatattgcaactcgaccgcaccatcaatatcaaattctggccatatttgaatgactttatctttatcgtaaacgagattattttgccaagatgcgataggtttaaattctttcccaaattctccactcaatgtgagctctgaattaccttggtaaacgacatctcctttaaaattcggatgcacaagtgctaacttaggagaaaccttatctccatactgtcctgagaagctaactgcctctaatttattattacgttcttcaatattccggtaatgtaatggttgaacaacgtatttttggacattttcgtcttgttcatattcaactgaccaaaatgattcatcaacatacgtattgtatggttcgcttatcatttgtaataaattcgttaatgtctccgagtatggtgcttgaatatagataaaatcaaagcgcccttctgcttcaacaatcgcttcaatagcctctacataaccactatcaaattcaaacaatccaatatcgaagtaatcccaactcacaccttttttgtgttgaaaaataggttctaaatcgtctcctccaatttgcaaaactctaaatttacgtggcatcattttcaccttctattaactcatcgagctgattaataatattcttagaagcatatgcatctattaattttaaagaataggcgtacgcataattccaatttttcaaataaaataaataataatttaacgcatcatctaattcatcaactgtatttataatacggccattgtcataatcagagacgtaatctgtttgttgaccattaatttgtggaatcccagcgctaattgcactaatttgtaaatacaagtcaggttcttttgacatatctatcacaagtcgcaacgtccgcaatgcttctacaacatcatgttcagcatgtatcgtcttaacagcaatgatgtcatcttgatc

SEQ ID NO: 112 - DNA, 233 bp, Staphylococcus aureus; identical to SEQ ID NO: 64

SEQ ID NO: 113 - DNA, 388 bp, Staphylococcus aureus; identical to SEQ ID NO: 81

SEQ ID NO: 114 - DNA, 943 bp, Staphylococcus aureus
cgatatctccaaattgtctaatcaagaccatttgtacaccttgcttatcattctttttatcacttagcatatattggtataacgtttcaaaatccaagtcagttatcatgtctaaaggatagccgagttgtattaaatattgaatataatgattaatatcatgcttagaatcaaacaaagcattcgcaactataaattgatagataatgccaaccatcactgcatgaccatgaggtattttatgatagtattcaacagcatgaccaaatgtatgacctaaatttaaaaatttacgtacaccttgttctttttcatctgcaataacaatatccagcttcgtttcaatacctttagcaatatatttatccataccatttaatgactgtaatatctctctatctttaaagtgctgttcgatatcttgcgtcgctgattcaccattcaataacgcatgcttataaacttctgcatagccacttaatatttgctcaaatggtaacgtctttaaaaagactaaatcataaatcacagcagttggacgataaaatgcaccgataaggtttttaccttgctttgagttaatacccactttaccgccaacactagaatcatgcgctagtatagtcgttggcacttgtataaagtgcacgcctcgtaaaagtgtcgccgcaataaacccagcaaaatcaccagttgcaccaccaccaacagcaataattgctgtattacgagttacatgatgggataaaatatactctaatgtttcttgatattgctcaaatgttttcgtcttttcaccagctggaataataactttatgtacattttcatatgataaaatatcatcaaatttatcagcaaaatattgatttacatgctcgtcaattaatataaaactttgatcaaactgatcaatatacgtgctaatatggtcaattgcacc

SEQ ID NO: 115 - DNA, 1595 bp, Staphylococcus aureus
cacttttgaatgttcacttctaaagatttggtctgtaacttccatttcagctaatccatatttttcataaatttcttgtccataaagtgtatttgtatcatggaatgctggtaaacaatgtaagaatatcgttgaatctttacctgttaaatcaaacatctgttgattcacttgatagtcttttaataaattaatacgttgttcaaattcactttcttcacccatcgatacccaaacatctgtatatatagcatctgtattttcaactgcttctgcaatattatccgtaatcatgactgaaccaccatattgactcgctttttcttttgcaatatcaacatatgcctcttttggatttaatgatttaggtgtacaaattcttacattaacacctaacatagcacctgctaccattaatgaatgcgcaatattattacgtccatctccaacgtaagttaagtttattccttctagatatccaaaattctcttttattgtcataaaatcagctaacatttgtgtaggatgccaatcgtctgttaatccattccacaccggtacaccagagaacttcgctaaatcttcaacagcttgttgtgaaaaaccacggaattcaataccatcgaacattctacctaatactttcgcagtatcctctacagattcttttttgcctaattgaatatcattttttcctaaaaattctggatgcgcacctaaatcaatagacgcaactgtaaacgcagcacgcgttctcgtcgaattcttttcgaatagtagtgcaatattttttccagataagtagtgatgcttaataccgtttttcttatactcttttaatgtaattgcaaaatcaataagtccttcgaattctgctttggtaaaatcactttcttttaataatgatctgccttttaaatcatacggtttttgaatttctgtcattattttcaccctcgtttctataatttattacgttaaatgtcctctctgaataatggttgactcatacatctagggcccccacgtccacgtaccaactcgctaccagatatttcaatgactttaatgcctttttgtctcaataaatcattcgatacatagtttctatcgtaagtcactacaacgcctggtcttatacataatgtatttgagccatcattccattgctctctagcaccatcaatgacatcaccatttcctgttggaatgaattggatatcatctatacctagtacgtcttctaaagtatcttttaaatgactagattgtttgatggcaatatctttatttacgtcatcatattcaataataaatatattcatattgccttctgcctttaaaatggctgaatgcattgtaaatttgtcataatctatcattgtaaatactgtatctaagtgcataaaagttcgactagttggaatttcaattgctactacttttttaaacgtcgcctgcggattttcaaaaatacgtcgcgctaacttttcaatagcttgtgcagatgtacgttctgaaacgcctatagccaagacatctttagataaaacaagttcatcgccgccttcaatattgaatgggcaatctcgatc

SEQ ID NO: 116 - DNA, 3730 bp, Staphylococcus aureus
caataccttgtggacaaataagtatgacatcttgattatctacattaaagtaatctgggcattcccacatatatccaaaatcatccaactctgtatttatttcacctaaataatgccaattaattatatcttcagtattataaagtaataatcgaccttgctgatcattattttgtgcaccaatgattgcataatatttctcatcatatttaaaaactttaggatctctaaaatgactcgtatatccttctggttgttggctaattactggctttggaaacttttcaactgaaccgtcttctttcaatcgtgcgatcatctgactcgcatgtcgttgccaatgattatctcgatgatttcctgtgtacatataatataaatgcccgttatattcaaaagcgctaccgctatatacaccatggctgtcatatttagtatctggatttaaaattggcccttcagctttaaagtttattaagtcatcactcgtgtagttataccaatactttaagccatgtactgcgcctaatgggaaccattgatgtgaaacataatacttccctttataaaaaataagtccgttggggtcatttaataagcctgtttctggttgtatatgaaattgttgacgaaattttgattgatcaacttgttgttttaatgttttaaaatactcagtatcaacgtcctcgattcgttgataacgttcttctctagtccattcggtcataatatttacccagtcctccttttataatttatgctgttaacaatttatattctattatagcaaattttacctacgttctttaacttttaacctatccatttatagttatatggtatcggttccacatttattttaaaaaatacagcgtctaaatattaacatctactgtgacgctatatggcatatcttgctttttaagcatctgttgtatctcttccatcgcgcattggccagcttcaaaataattataatgaattgtttttatcgatggagacactaattgtgtcattgggtcaccaccaaaaccatatatttgatgtggtttcataacatcttttttatcagaataatatttataggcagctaatgcaatcgtatcagttgctccaacaaccgcatctacttgctccacattttccaaaacatttgcaacatctttttgtgcttccacataagtaaaatttgtttcatgtatattaggtttaatttggtatttagctaactggtcaagtaaaccacgttttctatgtataccaactgcaatatctttttcacttacactaaacacttcaacttgttgatatccctgttgaccaatccattcgcctataatttgacctgctttataatcatcatgcacaatactatgaagttgttcatgttgttgaccaacaataacgattggtacattcattttattaatgacttcaatatgtctctctgttatgtctgtagccattaaaacaataccatctactttactgcgtgctaatgtttcaagcgcttgtatttctgcttcgatatttaaacctgtgtaatttaaaattaattgtgattcatatttttggcattgttttgccaatcctttgattgtttcatctactgcatatgaattcattctaggtataatggcaccaataaggtgtgtttgtctcgctcttaaactttgagcaaattgattcggttgatagtcatgttctgctataattcttgttaatttttcacttgtttttttactgacagatccattatttaaaaatctagatactgtactttttgaaacgcctgccaatttggcaatatcagatatatttttcatacttattcacctatcattatttgtgacacttagccttattttagcatatgtgtaaccgctttaaataatatttctgcttctttcataaaaagatttcaaaataaaacttttgtataacaaaatgtcccaacatcaacctttagttaaatgtcaggacaatgaatattctatgtaaatatattctaatatcgaatatgtttattgaatctatttagctcaccttcaaagtaagcatgttcaccgtgaacaatcttgtctaatcctatattcgtttcttgttccgtaacagataatggtgtaattaatttaattactttcgcaataataaacgtcatgactatactaaaaattacaactgctgttacacataatatttgtacaagtataatatgtatgtcaccagtataaataaagccattctcaatgtcaggattggcttttttactttggaaaactgctgttaaaacagcaccaataataccaccaacaccatgaataccaaatgcatctaatgcatcatgatattttagttttaccttgatgtaattaatgacaatataacaacagatacctcctattaaagccattattgttgcactaagatatgttacatatcctgctgcaggagtaatgacaactaatcctgctaatgcaccgagtaaaagtccaagtaaacttgtcgtctttttaaaaatatattctaaaattaaccaacctatagcacctgcactggctgaaatgacagtatttgtaaatgcaagcatcgcaatattatcaaatgtaaaagcactacctacattaaatccataccaaccaatccacacgaatataccgccaatcaacgtaatgataagattatgtggtgttgattcagaatgtttgtttccttttccaatcataatagctaatactaaaccagaaacacctgatgtaatatgaacaaccgtacctccagcgaaatctaatacaccgagtttgttaatccaaccgccgccccaaacccaatgtgctactggactgtatacaagagcagtccatattactacgaataataaataaggaataaacttcattttctcagcgattgaaccagataaaatagaaattgcaatcgtacaaaacatcatttgaaataacataaacaaagcgaaaggaatatgtgggctaatatcttcttgagtcgcaaaacctacatgattaagaaaagtatattcccaatttccgaaccataaattcccattcccaaaactaattgtaaaaccaactgttatccatacaaatgtaacaagcacaattgctgccatactttgcatgacagtattaagcgcatttttagattgaactaacccaccataaaataaacttaatcctggtgtcattaaccaaactaataatgtacacaaaaacataaatatcgtatcgttaagattcatacttaccactccctttttttcataataatctgacaatttataaaaagcaaaaatgcgttaagttttattacatcttttggaataaaatgtgccacactatataaaaatgatttcatgaactaaaaaaaaaaagactacttactcacttttaaattagcggaagtagccatagaatctaatatctattttattgttaaaatgataacgttaaactttttgaattgtaattgtccatgaagcattatcaatttgttcatagtttgttacaggataaccattttctgcagcccaatttggaatggcttccgtcgcttgcgtgcaatcaaaatcaatttttaattcatctccagattgcaatgttgccattttcttttgcgcttcaattaacggaaatggacataccattcctactgtacctaattcgtgtatcataattatttctccttttccaatcacttttatttgatc

SEQ ID NO: 117 - DNA, 759 bp, Staphylococcus aureus
gtctctttcaacaaccgcgtcatatttttcaacataaccttttttgataagtccatctaaactggattttgaaaagcccatatcctcaatatcagttaaaaatattgttttatgttgttcttcagacaagtaagcatacaaatcgtattgtttaataactttctccaacttagctaatacttcatcaggatgatacccttcaatgacacgaacagcacgcttggtttttttagttatattttgtgtgagaatcgttttttcttcaacgatatcatcttttaacaacttcataagcaattgaatatcattatttttttgcgcatctttataataatagtaaccatgcttatcaaatttttgtaataaagctgaaggtagctctatgtcatctttcatcttaaatgcttttttatacttcgctttaatagcactcggaagcatcacttctagcatagaaatacgtttaatgacatgagttgaacccatccactcacttaaagctattaattctgatgttaattctggttgtatatctttcacttctatgattttttttaacttcgaaacgtcaagttgtgcatcaggttctgctgttacttccattacataaccttgaatcgttcttggtccaaaaggtacaattacacgcacaccaggttggatgacagattcgagttgttcgggaattatataatcaaatttatagtcaacgctcttcgacgcgacatcgactatgactttcgctatcattattgccac

SEQ ID NO: 118 - DNA, 2361 bp, Staphylococcus aureus
gcgttgtgaattagtataatcaatttactggaagatatttagtcgattgatacctatcaactattttcagcatacgataaattataacaaatcatagtttattatcacacttaattattatatttttcaagggagaatacgaaatatgcctaaaaataaaattttaatttatttgctatcaactacgctcgtattacctactttagtttcacctaccgcttatgctgatacacctcaaaaagatactacagctaagacaacatctcatgattcaaaaaaatctaatgacgatgaaacttctaaggatactacaagtaaagatattgataaagcagacaaaaataatacaagtaaccaagacaataacgacaaaaaatttaaaactatagacgacagcacttcagactctaacaatatcattgattttatttataagaatttaccacaaaccaatataaaccaattgctaaccaaaaataaatacgatgataattactcattaacaactttaatccaaaacttattcaatttaaattcggatatttctgattacgaacaacctcgtaatggcgaaaagtcaacaaatgattcgaataaaaacagtgacaatagcatcaaaaatgacactgatacgcaatcatctaaacaagataaagcagacaatcaaaaagcacctaaatcaaacaatacaaaaccaagtacatctaataagcaaccaaattcgccaaagccaacacaacctaatcaatcaaatagtcaaccagcaagtgacgataaagcaaatcaaaaatcttcatcgaaagataatcaatcaatgtcagattcggctttagactctattttggatcaatacagtgaagatgcaaagaaaacacaaaaagattatgcatctcaatctaaaaaagacaaaaatgaaaaatctaatacaaagaatccacagttaccaacacaagatgaattgaaacataaatctaaacctgctcaatcattcaataacgatgttaatcaaaaggatacacgtgcaacatcattattcgaaacagatcctagtatatctaacaatgatgatagcggacaatttaacgttgttgactcaaaagatacacgtcaatttgtcaaatcaattgctaaagatgcacatcgcattggtcaagataacgatatttatgcgtctgtcatgattgcccaagcaatcttagaatctgactcaggtcgtagtgctttagctaagtcaccaaaccataatttattcggtatcaaaggtgcttttgaagggaattctgttccttttaacacattagaagctgatggtaatcaattgtatagtattaatgctggattccgaaaatatccaagcacgaaagaatcactaaaagattactctgaccttattaaaaatggtattgatggcaatcgaacaatttataaaccaacatggaaatcggaagccgattcttataaagatgcaacatcacacttatctaaaacatatgctacagatccaaactatgctaagaaattaaacagtattattaaacactatcaattaactcagtttgacgatgaacgcatgccagatttagataaatatgaacgttctatcaaggattatgatgattcatcagatgaattcaaacctttccgtgaggtatctgatagtatgccatatccacatggccaatgtacttggtacgtatataaccgtatgaaacaatttggtacatctatctcaggtgatttaggtgatgcacataattggaataatcgagctcaataccgtgattatcaagtaagtcatacaccaaaacgtcatgctgctgttgtatttgaggctggacaatttggtgcagatcaacattacggtcatgtagcatttgttgaaaaagttaacagtgatggttctatcgttatttcagaatccaatgttaaaggattaggtatcatttctcatagaactatcaacgcagctgccgctgaagaattatcatatattacaggtaaataagtattatattaaacccgtaaaatttataagtataaacaaggagttcggacttaaacatatttctgttcataagtccgatttcttattcaattaaacccgaggcattcagttcgaacgcctcgggtcgttttatataaatatattattttatgttcaaatgttcctcatcatatccgtttcaattgccatctcacacattttataaatatgagcaaatgtacttattctcaaacattactgccgagctttaattgacgttatattaactataaactacttttccatgactctacggattcaatgtcacatgagcgtgataaaatttgttcaataataaagtcatgtttatcatctga

SEQ ID NO: 119 - DNA, 972 bp, Staphylococcus aureus
ataatatttaagcctacactagctaacataccaatcatagaaaccattggtgccccaattgcacgtgcaaattgttctaatatgaagaacaaaattacaaaaggtgcacttaaaaacattactttcaaataattacttgttaaagctaacgtttcacctctcgcccctaaaattgctgcgatttgatcactgaatggtaaagtaactaaaatcacgataagtcctagtgcaataccaccataaatagagaaactacttacaaatttactcttactatagtctttcgcacctaataaacgtgaaatataagttcctgcaccaacgccaaataaattacctaaccccattaagatagcaaatactggcagtgttagagagatagcagaaatcatgtggctatcttctaaaaatcctataaagtaaatatttaatatgccataaataacgcttaataaagtccctatcatcattggcaatgagaaatgcatcatcgctttaaatactggcgatttctcaaaataatataattgttcgtctttcattgttcaatactccttgtcttttccaataattagcttactaacaattagatatctaactataatattaaagacaaagtgactgatttctaccagtcacacttatcatttattgtaaactagataacattttagttaagtttgctttcatttgttcattttcttcttcagataactgcgatacgagtgtttgttccatttcatcaaatatcgaagtgaatgcttctacgagtttaatcccagaggtagtcagccctatattctttcttctcgtatcttgtgcatcgacatagcgatagatcagctttttacgttcaaggttccttaataaattactgacagttggacctgttcgttgtaatgctttagcaatatcattttgtgtcagtccatcttgttgatgtgcataaagataacctaacgtatgaccttg

SEQ ID NO: 120 - DNA, 1176 bp, Staphylococcus aureus
gatccttcagaaatcaataaagttattcatgtagatttaggtattattgcagactgtaaaagatttttagaatgtttaaatgataaaaatgttgagactatagaacacagtgactgggttaaacattgtcaaaataataagcagaaacacccatttaaacttggtgaagaagatcaagtattttgtaagccacaacaaacaatcgaatatatcggcaaaattacaaatggtgaagcaattgttactacagacgtgggacaacatcaaatgtgggcagctcaattttatccatttaaaaatcacggacaatgggttacaagcggtggtttaggaacaatgggattcggtattccttcgtcaattggtgccaaattagctaatcctgataaaacagtcgtatgtttcgtcggtgacggtggtttccaaatgacaaaccaagaaatggcacttttacccgaatatggtttagatgtcaaaatcgtactaatcaataatggaacattaggtatggttaaacaatggcaagataagttctttaatcaacgcttctcacactcagtatttaatggtcaacctgattttatgaaaatggcagaagcatatggcgtcaaaggtttcttaatcgataagccagaacaactggaagaacaattagatgcagcgtttgcttatcaaggaccagctttaattgaggttcgtatttcccctactgaagctgtaaccccaatggttccgagtggcaaatcaaatcatgaaatggagggcttataatgacaagaattcttaaattacaagttgcggatcaagtcagcacgctaaatcgaattacaagtgcttttgttcgcctacaatataatatcgatacattacatgttacacattctgaacaacctgggatttctaacatggaaattcaagtcgatattcaagatgatacatcacttcatatattaattaaaaaattaaaacaacaaattaatgttttaacggttgaatgctacgaccttgttgataacgaagcttaattttaagacaaaggcaatgatgcgctaattagttatagatatatcataggctgctagttaacatctgccactattacaaagttatatttcagaattttcgaaacacaaaatatttaattatttggaggaatttattatgacaacagtttat

SEQ ID NO: 121 - DNA, 2189 bp, Staphylococcus aureus
gcgcaccaaactctcgtccaattgattttgaaatgaaaaagaaagatggaactcaacagttttatcattatgcaagttctgttaaacctgctagagttattttcactgattcaaaaccagaaattgaattaggattacaatcaggtcaattttggagaaaatttgaagtttatgaaggtgacaaaaagttgccaattaaattagtatcatacgatactgttaaagattatgcttacattcgcttctctgtatcaaacggaacaaaagctgttaaaattgttagttcaacacacttcaataacaaagaagaaaaatacgattacacattaatggaattcgcacaaccaatttataacagtgcagataaattcaaaactgaagaagattataaagctgaaaaattattagcgccatataaaaaagcgaaaacactagaaagacaagtttatgaattaaataaaattcaagataaacttcctgaaaaattaaaggctgagtacaagaagaaattagaggatacaaagaaagctttagatgagcaagtgaaatcagctattactgaattccaaaatgtacaaccaacaaatgaaaaaatgactgatttacaagatacaaaatatgttgtttatgaaagtgttgagaataacgaatctatgatggatacttttgttaaacaccctattaaaacaggtatgcttaacggcaaaaaatatatggtcatggaaactactaatgacgattactggaaagatttcatggttgaaggtcaacgtgttagaactataagcaaagatgctaaaaataatactagaacaattattttcccatatgttgaaggtaaaactctatatgatgctatcgttaaagttcacgtaaaaacgattgattatgatggacaataccatgtcagaatcgttgataaagaagcatttacaaaagccaataccgataaatctaacaaaaaagaacaacaagataactcagctaagaaggaagctactccagctacgcctagcaaaccaacaccatcacctgttgaaaaagaatcacaaaaacaagacagccaaaaagatgacaataaacaattaccaagtgttgaaaaagaaaatgacgcatctagtgagtcaggtaaagacaaaacgcctgctacaaaaccaactaaaggtgaagtagaatcaagtagtacaactccaactaaggtagtatctacgactcaaaatgttgcaaaaccaacaactgcttcatcaaaaacaacaaaagatgttgttcaaacttcagcaggttctagcgaagcaaaagatagtgctccattacaaaaagcaaacattaaaaacacaaatgatggacacactcaaagccaaaacaataaaaatacacaagaaaataaagcaaaatcattaccacaaactggtgaagaatcaaataaagatatgacattaccattaatggcattattagctttaagtagcatcgttgcattcgtattacctagaaaacgtaaaaactaataaatcgtctttatatttaattattaaattaacaaattttaattggcggatgaggtatccagttacctcgttcgccaattatttttcgcaatataaaaagtcccacttaaaacaatcattttaagcgggactttttatattgagtaactaaaattatttagctgctacttcttcgccattgtaagaaccacagtttttacatacacggtgtgataatttgtattcgaccacagtttgggcattcagtcatacctggtactgaaattttgaaatgcgtacgacgtttgttttttctagttttagaagttcttctttttggtactgccatgatatatcctccttagattataaacgaaaaatactaaatgttagtttaattaacaacattatatcattaattaaactacttattgctctttatcatataattgttgtaatttttgaagccttggatcaacttgtcgtgattctgaatcatcttgttgcttgctgtttagcaagctcatctaattgatcctcatcgattacttcccaaccattacctactgtcaacatttggtcactttgctctgaataagctctcattggtttctcaataataactatatcctcgacaatatcctgaagattaaccataccatctttaataatgtgatagtgttcatctacatcatcttgatc

SEQ ID NO: 122 - DNA, 2160 bp, Staphylococcus aureus
ggatctgatattttatcaatgtgcttgtcatcttttttaatatcatctaacgttttcttaatatctttagtaatgttcggttgcacaataccatcatctttagtcgtcttaaagacaacacgtatttgtgccttttcactatcttgattaaaatgtttttcaatctttttattcgtatctaacgactctaatcctgtcattttaatatcattgtcaaatttcggtgcatttgtagcaagtggtatcaatattgcagctacaatcactatccatgcaatgaccgcggaccatttatgttttgcgatgaatgtccccatcttatataaaaattttgccaaagtatattgcctccttttaaaatcaacgttatagtttaaatatacagtgtagattattgttcgattatagtatctatccccgacctcttaaagaatcaattggaaaattttgtatattaaactacacacaaaggagaaatgtagatgaaagagactgatttacgagttataaagacaaaaaaagcattgtcgagtagcttgctacaattgttagaacagcaattattccaaacgattactgtcaatcaaatttgcgacaacgcactcgtacaccgtacaacattttataaacatttttatgataaatatgatcttctagagtacttgttcaatcaattgactaaagactactttgctagagatatcagtgaccgtcttaatcatccattccaaacgatgagtgatacgattaataataaagaggatttgagagaaatcgcagaattccaagaagaagacgctgaatttaataaagtattaaaaaatgtctgcattaaaattatgcataacgatatcaaaaataatagagaccgtatcgatattgacagcgacatcccagataatctcatattttatatttatgactcgttgattgaaggttttatacattggataaaagatgaaaaaattgattggcctggcgaagatattgataacattttccatagattaatcaatattaagattaaatagtagatgagaaactcatgagcgttaccaacattcataataaaaacgatagtgtacacgttaatgaattcgtgtactactatcgttttttatttttatcgtgcttatcgctattaaaacaactgatacacaacacataaactatgaagaaaaaaataaatccgctatctaaatgactttgactcagttgtttaaatgaccaaattgctaatacaattcccattattattgaaataacgtatctcacattcttatacctataatccttttctaaaaatatggttgctattacttaatttttaaagttataaataaaaagagccaaccgcaatggatggcccttgttcattatgaagcattagaacatttctgaaacaaccttttgttctaagaagtgtaataagtagtctggactacctgttttagcgtccgtacctgacattttgaaaccaccaaatggatggtatccaacaactgctgaagtacagcctctgttaaggtataaattgcctacatcaaattcgtttaccgctttaatccaatgctcgcgattatttgtaatcactgcaccagttaaaccgtaatctgtatcatttgcaacctcaattgcttcatcaaaatcgttaactttcacaaagccaacaactggaccaaaaatttcttcttgcatgattctatctttagatttaagtcctgaaatgattgttggttctacaaagtaaccttttgaatcatcagtgccgccaccttgttctaatttaccttcttctttaccaatctcaatataatttttaatcttatcaaattgttttttattaataactgggcccatatacgtattgtctacagtattgcccaacgttaattcttttgttaatttgattgatttctctaatacttcgtcataaacgtctttatgcacaattgcacgtgaacatgctgaacatttttgaccagaaaaaccaaatgctgacgttacaatagcttctgctgccatatctgtatcaatattttcatcaactacaatggcatctttaccacccatttcagcgataacacgtttcaagaagttttgaccttcttgaacaacggcactacgttcataaattctagtacctgtcgcacgtgatcc

SEQ ID NO: 123 - protein, 313 aa, Staphylococcus aureus
MEHTTMKITTIAKTSLALGLLTTGVITTTTQAANATTLSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 124 - protein, 45 aa, Staphylococcus aureus
MFVKVAFLCLKSDETSNVPSVESHQNHFYLTNIMDFLIYLTMIQI

SEQ ID NO: 125 - protein, 361 aa, Staphylococcus aureus
MEHTIMKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 126 - protein, 251 aa, Staphylococcus aureus
MYDSNYVIKQSNYNRLEHTTMKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 127 - protein, 1263 aa, Staphylococcus aureus
MLGVINRMAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKTAAPKAATTSAPKAKTEATPKVTTFSASAQPRSVAATPKTSLPKYKPQVNSSINDYICKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMTLNQVAQIQAGLQYKPQVQRVPGKWTDAKFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 128 - protein, 327 aa, Staphylococcus aureus
DRKPVTVADLKVEGALAMILKDAIKPNLVQSIEGTPALVHGGPFANIAHGCNSILATETARDLADIVVTEAGFGSDLGAEKFMDIKAREAGFDPAAVVVVATIRALKMHGGVAKDNLKEENVEAVKAGIVNLERHVNNIKKFGVEPVVAINAFIHDTDAEVEYVKSWAKENNVRIALTEVWEKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 129 - protein, 895 aa, Staphylococcus aureus
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNISTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 130 - protein, 30 aa, Staphylococcus aureus
MKIILLLFLIFGFIVVVTLKSEHQLTLFSI

SEQ ID NO: 131 - protein, 948 aa, Staphylococcus aureus
LHLRENIIVKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 132 - protein, 387 aa, Staphylococcus aureus
DQQKAFYQVLHLKGITEEQRNQYIKTLREHPERAQEVFSESLKDSKNPDRRVAQQNAFYNVLKNDNLTEQEKNNYIAQIKENPDRSQQVWVESVQSSKAKERQNIENADKAIKDFQDNKAPHDKSAAYEANSKLPKDLRDKNNRFVEKVSIEKAIVRHDERVKSANDAISKLNEKDSIENRRLAQREVNKAPMDVKEHLQKQLDALVAQKDAEKKVAPKVEAPQIQSPQIEKPKVESPKVEVPQIQSPKVEVPQSKLLGYYQSLKDSFNYGYKYLTDTYKSYKEKYDTAKYYYNTYYKYKGAIDQTVLTVLGSGSKSYIQPLKVDDKNGYLAKSYAQVRNYVTESINTGKVLYTFYQNPTLVKTAIKAQETASSIKNTLSNLLSFWK

SEQ ID NO: 133 - protein, 321 aa, Staphylococcus aureus
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 134 - protein, 172 aa, Staphylococcus aureus
VKLMLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYT

SEQ ID NO: 135 - protein, 422 aa, Staphylococcus aureus
MSKFIEPSVEEIKLEKVYQDMGLSDQEYEKVCDILGRQPNFTETGIFSVMWSEHCSYKHSKPFLKQFPTSGDHVLMGPGEGAGVVDIGDNQAVVFKVESHNHPSAIEPYQGAATGVGGIIRDIVSIGARPINLLNSLRFGELDNKQNQRLLKGVVKGIGGYGNCIGIPTTAGEIEFDERYDGNPLVNAMCVGVINHDMIQKGTAKGVGNSVIYVGLKTGRDGIHGATFASEELTEESESKRPSVQIGDPFVGKKLMEATLEAITFDELVGIQDMGAAGLTSSSSEMAAKGGSGLHLRLEQVPTREPGISPYEMMLSETQERMLLVVEKGTEQKFLDLFDKHELDSAVIGEVTDTNRFVLTYDDEVYADIPVEPLADEAPVYILEGEEKDYNTSKNDYTHIDVKDTFFKLLKHPTIASKHYLY

SEQ ID NO: 136 - protein, 485 aa, Staphylococcus aureus
MTDIINKLQAFADANPQSIAVRHTTDELTYQQLMDESSKLAHRLQGSKKPMILFGHMSPYMIVGMIGAIKAGCGYVPVDTSIPEDRIKMIINKVQPEFVFNTTDESFESLEGEVFTIEDIKTSQDPVIFDSQIKDNDTVYTIFTSGSTGEPKGVQIEYASLVQFTEWMLELNKSGNEQQWLNQAPFSFDLSVMAIYPCLASGGTLNLVDKNMINKPKLLNEMLTATPINIWVSTPSFMEMCLLLPTLNEEQYGSLNEFFFCGEILPHRAAKALVNRFPSATIYNTYGPTEATVAVTSIQITQEILDQYPTLPVGVERPGARLSTTDEGELVIEGQSVSLGYLKNDQKTAEVFNFDDGIRTYHTGDKAKFENGQWFIQGRIDFQIKLNGYRMELEEIETQLRQSEFVKEAIVVPVYKNDKVIHLIGAIVPTTEVTDNAEMTKNIKNDLKSRLPEYMIPRKFEWMEQLPLTSNGKIDRKKIAEVING

SEQ ID NO: 137 - protein, 67 aa, Staphylococcus aureus
MNGLYKGVFTKNFKRCNMKSKSKQPPNKYVEAFKPYLLTLLYLAIFITLYLIYGSGDTHNNFIYNEF

SEQ ID NO: 138 - protein, 36 aa, Staphylococcus aureus
MMTTNYYVESIKLKLNFIMNIDIMNCKKQILKRILY

SEQ ID NO: 139 - protein, 45 aa, Staphylococcus aureus
DPNIHQAVVQDDNPDFESGEITQELQKGYKLKDRVLRPSMVKVNQ

SEQ ID NO: 140 - protein, 321 aa, Staphylococcus aureus
MIKWRNFIMSKIIGIDLGTTNSCVTVLEGDEPKVIQNPEGSRTTPSVVAFKNGETQVGEVAKRQAITNPNTVQSIKRHMGTDYKVDIEGKSYTPQEISAMILQNLKNTAESYLGEKVDKAVITVPAYFNDAERQATKDAGKIAGLEVERIINEPTAAALAYGLDKTDKDEKVLVFDLGGGTFDVSILELGDGVFEVLSTAGDNKLGGDDFDQVIIDYLVAEFKKENGVDLSQDKMALQRLKDAAEKAKKDLSGVSQTQISLPFISAGENGPLHLEVNLTRSKFEELSDSLIRRTMEPTRQAMKDAGLTNSDIDEVILVGGS

SEQ ID NO: 141 - protein, 1290 aa, Staphylococcus aureus
DQNTIKQGVNFTDADEAKRNAYTNAVTQAEQILNKAQGPNTSKDGVETALENVQRAKNELNGNQNVANAKTTAKNALNNLTSINNAQKEALKSQIEGATTVAGVNQVSTTASELNTAMSNLQNGINDEAATKAALNGTQNLEKAKQHANTAIDGLSHLTNAQKEALKQLVQQSTTVAEAQGNEQKANNVDAAMDKLRQSIADNATTKQNQNYTDASQNKKDAYNNAVTTAQGIIDQTTSPTLDPTVINQAAGQVSTTKNALNGNENLEAAKQQASQSLGSLDNLNNAQKQTVTDQINGAHTVDEANQIKQNAQNLNTAMGNLKQAIADKDATKATVNFTDADQAKQQAYNTAVTNAENIISKANGGNATQAEVEQAIKQVNAAKQALNGNANVQHAKDEATALINSSNDLNQAQKDALKQQVQNATTVAGVNNVKQTAQELNNAMTQLKQGIADKEQTKADGNFVNADPDKQNAYNQAVAKAEALISATPDVVVTPSEITAALNKVTQAKNDLNGNTNLATAKQNVQHAIDQLPNLNQAQRDEYSKQITQATLVPNVNAIQQAATTLNDAMTQLKQGIANKAQIKGSENYHDADTDKQTAYDNAVTKAEELLKQTTNPTMDPNTIQQALTKVNDTNQALNGNQKLADAKQDAKTTLGTLDHLNDAQKQALTTQVEQAPDIATVNNVKQNAQNLNNAMTNLNNALQDKTETLNSINFTDADQAKKDAYTNAVSHAEGILSKANGSNASQTEVEQAMQRVNEAKQALNGNDNVQRAKDAAKQVITNANDLNQAMTQLKQGIADKDQTKANGNFVNADTDKQNAYNNAVAHAEQIISGTPNANVDPQQVAQALQQVNQAKGDLNGNHNLQVAKDNANTAIDQLPNLNQPQKTALKDQVSHAELVTGVNAIKQNADALNNAMGTLKQQIQANSQVPQSVDFTQADQDKQQAYNNAANQAQQIANGIPTPVLTPDTVTQAVTTMNQAKDALNGDEKLAQAKQEALANLDTLRDLNQPQRDALRNQINQAQALATVEQTKQNAQNVNTAMSNLKQGIANKDTVKASENYHDADADKQTAYTNAVSQAEGIINQTTNPTLNPDEITRALTQVTDAKNGLNGEAKLATEKQNAKDAVSGMTHLNDAQKQALKGQIDQSPEIATVNQVKQTATSLDQAMDQLSQAINDKAQTLADGNYLNADPDKQNAYKQAVAKAEALLNKQSGTNEVQAQVESITNEVNAAKQALNGNDNLANAKQQAKQQLANLTHLNDAQKQSFESQITQAPLVTDVTTINQKAQ

SEQ ID NO: 142 - protein, 221 aa, Staphylococcus aureus
SFSLFIVLEKRATNPLIDFKLFKNKAYTGATASNFLLNGVAGTLIVANTFVQRGLGYSSLQAGSLSITYLVMVLIMIRVGEKLLQTLGCKKPMLIGTGVLIVGECLISLTFLPEIFYVICCIIGYLFFGLGLGIYATPSTDTAIANAPLEKVGVAAGIYKMASALGGAFGVALSGAVYAIVSNMTNIYTGAMIALWLNAGMGILSFVIILLLVPKQNDTQL

SEQ ID NO: 143 - protein, 225 aa, Staphylococcus aureus
MNYRDKIQKFSIRKYTVGTFSTVIATLVFLGFNTSQAHAAETNQPASVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSND

SEQ ID NO: 144 - protein, 758 aa, Staphylococcus aureus
DQEKRQAYDSKVTNAENIISGTPNATLTVNDVNSAASQVNAAKTALNGDNNLRVAKEHANNTIDGLAQLNNAQKAKLKEQVQSATTLDGVQTVKNSSQTLNTAMKGLRDSIANEATIKAGQNYTDASPNNRNEYDSAVTAAKAIINQTSNPTMEPNTITQVTSQVTTKEQALNGARNLAQAKTTAKNNLNNLTSINNAQKDALTRSIDGATTVAGVNQETAKATELNNAMHSLQNGINDETQTKQTQKYLDAEPSKKSAYDQAVNAAKAILTKASGQNVDKAAVEQALQNVNSTKTALNGDAKLNEAKAAAKQTLGTLTHINNAQRTALDNEITQATNVEGVNTVKAKAQQLDGAMGQLETSIRDKDTTLQSQNYQDADDAKRTAYSQAVNAAATILNKTAGGNTPKADVERAMQAVTQANTALNGIQNLDRAKQAANTAITNASDLNTKQKEALKAQVTSAGRVSAANGVEHTATELNTAMTALKRAIADKAETKASGNYVNADANKRQAYDEKVTAAENIVSGTPTPTLTPADVTNAATQVTNAKTQLNGNHNLEVAKQNANTAIDGLTSLNGPQKAKLKEQVGQATTLPNVQTVRDNAQTLNTAMKGLRDSIANEATIKAGQNYTDASQNKQTDYNSAVTAAKAIIGQTTSPSMNAQEINQAKDQVTAKQQALNGQENLRTAQTNAKQHLNGLSDLTDAQKDAVKRQIEGATHVNEVTQAQNNADALNTAMTNLKNGIQDQNTIKQGVNFTDADE

SEQ ID NO: 145 - protein, 1107 aa, Staphylococcus aureus
SQAINDKAQTLADGNYLNADPDKQNAYKQAVAKAEALLNKQSGTNEVQAQVESITNEVNAAKQALNGNDNLANAKQQAKQQLANLTHLNDAQKQSFESQITQAPLVTDVTTINQKAQTLDHAMELLRNSVADNQTTLASEDYHDATAQRQNDYNQAVTAANNIINQTTSPTMNPDDVNGATTQVNNTKVALDGDENLAAAKQQANNRLDQLDHLNNAQKQQLQSQITQSSDIAAVNGHKQTAESLNTAMGNLINAIADHQAVEQRGNFINADTDKQTAYNTAVNEAAAMINKQTGQNANQTEVEQAITKVQTTLQALNGDHNLQVAKTNATQAIDALTSLNDPQKTALKDQVTAATLVTAVHQIEQNANTLNQAMHGLRQSIQDNAATKANSKYINEDQPEQQNYDQAVQAANNIINEQTATLDNNAINQAATTVNTTKAALHGDVKLQNDKDHAKQTVSQLAHLNNAQKHMEDTLIDSETTRTAVKQDLTEAQALDQLMDALQQSIADKDATRASSAYVNAEPNKKQSYDEAVQNAESIIAGLNNPTINKGNVSSATQAVISSKNALDGVERLAQDKQTAGNSLNHLDQLTPAQQQALENQINNATTRDKVAEIIAQAQALNEAMKALKESIKDQPQTEASSKFINEDQAQKDAYTQAVQHAKDLINKTTDPTLAKSIIDQATQAVTDAKNNLHGDQKLAQDKQRATETLNNLSNLNTPQRQALENQINNAATRGEVAQKLTEAQALNQAMEALRNSIQDQQQTEAGSKFINEDKPQKDAYQAAVQNAKDLINQTNNPTLDKAQVEQLTQAVNQAKDNLHGDQKLADDKQHAVTDLNQLNGLNNPQRQALESQINNAATRGEVAQKLAEAKALDQAMQALRNSIQDQQQTESGSKFINEDKPQKDAYQAAVQNAKDLINQTGNPTLDKSQVEQLTQAVTTAKDNLHGDQKLARDQQQAVTTVNALPNLNHAQQQALTDAINAAPTRTEVAQHVQTATELDHAMETLKNKVDQVNTDKAQPNYTEASTDKKEAVDQALQAAESITDPTNGSNANKDAVDQVLTKLQEKENELNGNERVAEAKTQAKQTIDQLTHLNADQIATAKQNI

SEQ ID NO: 146 - protein, 706 aa, Staphylococcus aureus
DRVLASHPDVATIRQNVTAANAAKSALDQARNGLTVDKAPLENAKNQLQHSIDTQTSTTGMTQDSINAYNAKLTAARNKIQQINQVLAGSPTVEQINTNTSTANQAKSDLDHARQALTPDKAPLQTAKTQLEQSINQPTDTTGMTTASLNAYNQKLQAARQKLTEINQVLNGNPTVQNINDKVTEANQAKDQLNTARQGLTLDRQPALTTLHGASNLNQAQQNNFTQQINAAQNHAALETIKSNITALNTAMTKLKDSVADNNTIKSDQNYTDATPANKQAYDNAVNAAKGVIGETTNPTMDVNTVNQKAASVKSTKDALDGQQNLQRAKTEATNAITHASDLNQAQKNALTQQVNSAQNVQAVNDIKQTTQSLNTAMTGLKRGVANHNQVVQSDNYVNADTNKKNDYNNAYNHANDIINGNAQHPVITPSDVNNALSNVTSKEHALNGEAKLNAAKQEANTALGHLNNLNNAQRQNLQSQINGAHQIDAVNTIKQNATNLNSAMGNLRQAVADKDQVKRTEDYADADTAKQNAYNSAVSSAETIINQTTNPTMSVDDVNRATSAVTSNKNALNGYEKLAQSKTDAARAIDALPHLNNAQKADVKSKINAASNIAGVNTVKQQGTDLNTAMGNLQGAINDEQTTLNSQNYQDATPSKKTAYTNAVQAAKDILNKSNGQNKTKDQVTEAMNQVNSAKNNLDGTRLLD

SEQ ID NO: 147 - protein, 119 aa, Staphylococcus aureus
MLMKSLFEKAQQFGKSFMLPIAILPAAGLLLGIGGALSNPNTVKAYPILDITLLQNIFTLMSAAGSIVFQNLPVIFAIGVAIGLSRSDKGTAGLAALLGFLIMNATMNGLLTITGTLAK

SEQ ID NO: 148 - protein, 199 aa, Staphylococcus aureus
MKRKIIMDCDPGHDDAIALILAGAIDSPLEILAVTTVAGNQSVDKNTTNALNVLDIMGRQDIAVAKGADRPLIKPAAFASEIHGESGLDGPKLPSTPSRQAVAMPASDVIINKVMTSDTPVTIVATGPLTNVATALIREPRIAEHIESITLMGGGTFGNWTPTAEFNIWVDAEAAKRVFESGITINVFGLDVTHQVLAD

SEQ ID NO: 149 - protein, 40 aa, Staphylococcus aureus
MHQLKALLVLTHPRYYKTSQKHHYLIYLNKNSQSYLILFL

SEQ ID NO: 150 - protein, 261 aa, Staphylococcus aureus
MIFMTNNKVALVTGGAQGIGFKIAERLVEDGFKVAVVDFNEEGAKAAALKLSSDGTKAIAIKADVSNRDDVFNAVRQTAAQFGDFHVMVNNAGLGPTTPIDTITEEQFKTVYGVNVAGVLWGIQAAHEQFKKFNHGGKIINATSQAGVEGNPGLSLYCSTKFAVRGLTQVAAQDLASEGITVNAFAPGIVQTPMMESIAVATAEEAGKPEAWGWEQFTSQIALGRVSQPEDVSNVVSFLAGKDSDYITGQTIIVDGGMRFR

SEQ ID NO: 151 - protein, 208 aa, Staphylococcus aureus
MEKNVEKSFIKIGLYFQIAYIVLMAITLCGFVICYGLIFGLFYLLSGSRADYLIVTIVISAIISIFVIILSIVPVIVLASDLFKERISKGVILIVLAIIALVLCNFVSAILWFVSAISILGRKKLVAAADTTTIQKSKGNANQASHKDTCKKELDSQDMMEHPEVKNPTTKNLEGFNEEIHKDEATTKVVSDNTEPPIESKDHVSKKD

SEQ ID NO: 152 - protein, 1450 aa, Staphylococcus aureus
RGGVGADGITGDGAGIMTEIPFAFFKQHVTDFDIPGEGEYAVGLFFSKERILGSEHEVVFKKYFEGEGLSILGYRNVPVNKDAIAKHVADTMPVIQQVFIDIRDIEDVEKRLFLARKQLEFYSTQCDLELYFTSLSRKTIVYKGWLRSDQIKKLYTDLSDDLYQSKLGLVHSRFSTNTFPSWKRAHPNRMLMHNGEINTIKGNVNWMRARQHKLIETLFGEDQHKVFQIVDEDGSDSAIVDNALEFLSLAMEPEKAAMLLIPEPWLYNEANDANVRAFYEFYSYLMEPWDGPTMISFCNGDKLGALTDRNGLRPGRYTITKDNFIVFSSEVGVVDVPESNVAFKGQLNPGKLLLVDFKQNKVIENNDLKGAIAGELPYKAWIDNHKVDFDFENIQYQDSQWKDETLFKLQRQFAYTKEEIHKYIQELVEGKKDPIGAMGYDAPIAVLNERPESLFNYFKQLFAQVTNPPIDAYREKIVTSELSYLGGEGNLLAPDETVLDRIQLKRPVLNESHLAAIDQEHFKLTYLSTVYEGDLEDALEALGREAVNAVKQGAQILVLDDSGLVDSNGFAMPMLLAISHVHQLLIKADLRMSTSLVAKSGETREVHHVACLLAYGANAIVPYLAQRTVEQLTLTEGLQGTVVDNVKTYTDVLSEGVIKVMAKMGISTVQSYQGAQIFEAIGLSHDVIDRYFTGTQSKLSGISIDQIDAENKARQQSDDNYLASGSTFQWRQQGQHHAFNPESIFLLQHACKENDYAQFKAYSEAVNKNRTDHIRHLLEFKACTPIDIDQVEPVSDIVKRFNTGAMSYGSISAEAHETLAQAMNQLGGKSNSGEGGEDAKRYEVQVDGSNKVSAIKQVASGRFGVTSDYLQHAKEIQIKVAQGAKPGEGGQLPGTKVYPWIAKTRGSTPGIGLISPPPHHDIYSIEDLAQLIHDLKNANKDADIAVKLVSKTGVGTIASGVAKAFADKIVISGYDGGTGASPKTSIQHAGVPWEIGLAETHQTLKLNDLRSRVKLETDGKLLTGKDVAYACALGAEEFGFATAPLVVLGCIMMRVCHKDTCPVGVATQNKDLRALYRGKAHHVVNFMHFIAQELREILASLGLKRVEDLVGRTDLLQRSSTLKANSKAASIDVEKLLCPFDGPNTKEIQQNHNLEHGFDLTNLYEVTKPYIAEGRRYTGSFTVNNEQRDVGVITGSEISKQYGEAGLPENTINVYTNGHAGQSLAAYAPKGLMIHHTGDANDYVGKGLSGGTVIVKAPFEERQNEIIAGNVSFYGATSGKAFINGSAGERFCIRNSGVDVVVEGIGDHGLEYMTGGHVINLGDVGKNFGQGMSGGIAYVIPSDVEAFVENNQLDTLSFTKIKHQEEKAFIKQMLEEHVSHTNSTRAIHVLKHFDRIEDVVVKVIPKDYQLMMQKIHLHKSLHDNEDEAMLAAFYDDSKTIDAKHKPAVVY

SEQ ID NO: 153 - protein, 472 aa, Staphylococcus aureus
MRVIMEIILFLTMMVMITYVFSGYLYRVALVQSSRVDLIFTRFENMCFKIIGTDLEHMSAKTYVKHFLAFNGFMGFITFVLLIVQQWLFLNPNHNLNQSIDLAFNTAISFLTNSNLQHYNGESDVTYLTQMIVMTYLMFTSSASGYAVCIAMLRRLTGLTNIIGNFYQDIVRFIVRVLLPLSCLISILLMTQGVPQTLHANLMIRTLSGHIQHIAFGPIASLESIKHLGTNGGGFLAGNSATPFENPNIWSNFIEMGSMMLLPMSMLFLFGRMLSRHGKRVHRHALILFVAMFFIFIAILTLTMWSEYRGNPILANLGIYGPNMEGKEVRFGAGLSALFTVITTAFTTGSVNNMHDSLTPIGGLGPMVLMMLNVVFGGEGVGLMNLLIFVLLTVFICSLMVGKTPEYLNMPIGAREMKCIVLVFLIHPILILVFSALAFMIPGASESITNPSFHGISQVMYEMTSAAANNGS

SEQ ID NO: 154 - protein, 265 aa, Staphylococcus aureus
DPELGKYWASLGDVFVNDAFGTAHREHASNVGISTHLETAAGFLMDKEIKFIGGVVNDPHKPVVAILGGAKVSDKINVIKNLVNIADKIIIGGGMAYTFLKAQGKEIGISLLEEDKIDFAKDLLEKHGDKIVLPVDTKVAKEFSNDAKITVVPSDSIPADQEGMDIGPNTVKLFADELEGAHTVVWNGPMGVFEFSNFAQGTIGVCKAIANLKDAITIIGGGDSAAAAISLGFENDFTHISTGGGASLEYLEGKELPGIKAINNK

SEQ ID NO: 155 - protein, 286 aa, Staphylococcus aureus
MACLFNIVTGKQSQDDIVFHHFSKIFTKQGVSLMRTPIIAGNWKMNKTVQEAKDFVNTLPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 156 - protein, 252 aa, Staphylococcus aureus
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDAVI

SEQ ID NO: 157 - protein, 249 aa, Staphylococcus aureus
VDLNDRLTFHKRKDRKIVVEIEHNYVPSNHKNLAYRAAQLFIEQYQLKQGVTISIDKEIPVSAGLAGGSADAAATLRGLNRLFDIGASLEELALLGSKIGTDIPFCIYNKTALCTGRGEKIEFLNKPPSAWVILAKPNLGISSPDIFKLINLDKRYDVHTKMCYEALENRDYQQLCQSLSNRLEPISVSKHPQIDKLKNNMLKSGADGALMSGSGPTVYGLARKESQAKNIYNAVNGCCNEVYLVRLLG

SEQ ID NO: 158 - protein, 179 aa, Staphylococcus aureus
MRYKRSERIVFMTQYLMNHPNKLIPLTFFVKKFKQAKSSISEDVQIIKNTFQKEKLGTVITTAGASGGVTYKPMMSKEEATEVVNEVITLLEEKERLLPGGYLFLSDLVGNPSLLNKVGKLIASIYMEEKLDAVVTIATKGISLANAVANILNLPVVVIRKDNKVTEGSTVSINYVSGS

SEQ ID NO: 159 - protein, 137 aa, Staphylococcus aureus
DRTALEEQEATFGRKRHSGAPLTGGKEFDEIDLKAKDSHGEYIIDKDAHTRLAKEANTSILRRAFNYVDGTDDRTGNFETGLLFIAFQKATKQFIDIQNNLGSNDKLNEYITHRGSASFLVLPGVSKGGYLGETLFD

SEQ ID NO: 160 - protein, 513 aa, Staphylococcus aureus
MLVREDTLVKHYLTKFVAMLITAAMVCSFGLLKSQAAEQQSISDVYSVITDAKSALSNNSISNDNKQKAIEQVVSAVKKLSLEDNSESNAVKSDVRKLEDAKANDNQKDTLSQLTKSLIAYEEKLASKDAGSKIKLLQQQVDAKDAAMTKAIKDKNKAELESLNNSLNQIWTSNETVIRNYDANQYGQIEVALLQLRIAIHKSPLDTAKVSHAWTTFKSNIDHVDKKSNTSANDQYHVSQLNDALEKAIKAIDDNQLSDADAALTHFIETWPYVEGQIQTKDGALYTKIEDKIPYYQSVLDEHNKAHVKDGLVDLNNQIKEVVGHSYSFVDVMIIFLREGLEVLLIVMTLTTMTRNVKDKKGTASVIGGAIAGLVLSIILAITFVETLGNSGILRESMEAGLGIVAVILMFIVGVWMHKRSNAKRWNDMIKNMYANAISNGNLVLLATIGLISVLREGVEVIIFYMGMIGELATKDFIIGIALAIVILIIFALLFRFIVKLIPIFYIFRVLSI

SEQ ID NO: 161 - protein, 309 aa, Staphylococcus aureus
MTEIDFDIAIIGAGPAGMTAAVYASRANLKTVMIERGIPGGQMANTEEVENFPGFEMITGPDLSTKMFEHAKKFGAVYQYGDIKSVEDKGEYKVINFGNKELTAKAVIIATGAEYKKIGVPGEQELGGRGVSYCAVCDGAFFKNKRLFVIGGGDSAVEEGTFLTKFADKVTIVHRRDELRAQRILQDRAFKNDKIDFIWSHTLKSINEKDGKVGSVTLTSTKDGSEETHEADGVFIYIGMKPLTAPFKDLGITNDVGYIVTKDDMTTSVPGIFAAGDVRDKGLRQIVTATGDGSIAAQSAAEYIEHLND

SEQ ID NO: 162 - protein, 139 aa, Staphylococcus aureus
HYRLYGIFLLDQLNGKEIVMTESIWQVLENLNNYEKLYLTYLVQGLTLNKLDFIHRGLLTLYHNELFVSENDVMVAWINQGELIIAEKVDLTDVEPYIGAFIYLYFKNQPRNVTKKQITTWLGITQYKLNKMIEFLLSI

SEQ ID NO: 163 - protein, 39 aa, Staphylococcus aureus
DDEIILLNPMGMAIEDISSAYFIYQQAQQQNIGTTLNLY

SEQ ID NO: 164 - protein, 584 aa, Staphylococcus aureus
MQNHTAVNTAQAIILRDLVDALLFEDIAGIVSNSEITKENGQTLLIYERETQQIKIPVYFSALNMFRYESSQPITIEGRVSKQPLTAAEFWQTIANMNCDLSHEWEVARVEEGLTTAATQLAKQLSELDLASHPFVMSEQFASLKDRPFHPLAKEKRGLREADYQVYQAELNQSFPLMVAAVKKTHMIHGDTANIDELENLTVPIKEQATDMLNDQGLSIDDYVLFPVHPWQYQHILPNVFAKEISEKLVVLLPLKFGDYLSSSSMRSLIDIGAPYNHVKVPFAMQSLGALRLTPTRYMKNGEQAEQLLRQLIEKDEALAKYVMVCDETAWWSYMGQDNDIFKDQLGHLTVQLRKYPEVLAKNDTQQLVSMAALAANDRTLYQMICGKDNISKNDVMTLFEDIAQVFLKVTLSFMQYGALPELHGQNILLSFEDGRVQKCVLRDHDTVRIYKPWLTAHQLSLPKYVVREDTPNTLINEDLETFFAYFQTLAVSVNLYAIIDAIQDLFGVSEHELMSLLKQILKNEVATISWVTTDQLAVRHILFDKQTWPFKQILLPLLYQRDSGGGSMPSGLTTVPNPMVTYD

SEQ ID NO: 165 - protein, 403 aa, Staphylococcus aureus
MINQSIWRSNFRILWLSQFIAIAGLTVLVPLLPIYMASLQNLSVVEIQLWSGIAIAAPAVTTMIASPIWGKLGDKISRKWMVLRALLGLAVCLFLMALCTTPLQFVLVRLLQGLFGGVVDASSAFASAEAPAEDRGKVLGRLQSSVSAGSLVGPLIGGVTASILGFSALLMSIAVITFIVCIFGALKLIETTHMPKSQTPNINKGIRRSFQCLLCTQQTCRFIIVGVLANFAMYGMLTALSPLASSVNHTAIDDRSVIGFLQSAFWTASILSAPLWGRFNDKSYVKSVYIFATIACGCSAILQGLATNIEFLMAARILQGLTYSALIQSVMFVVVNACHQQLKGTFVGTTNSMLVVGQIIGSLSGAAITSYTTPATTFIVMGVVFAVSSLFLICSTITNQIND

SEQ ID NO: 166 - protein, 375 aa, Staphylococcus aureus
LPDNFKTYCAKMSIKTSSIQYENDDIMRESYGDDYGIACCVSAMTIGKQMQFFGARANLAKTLLYAINGGKDEKSGAQVGPNFEGINSEVLEYDEVFKKFDQMMDWLAGVYINSLNVIHYMHDKYSYERIEMALHDTEIVRTMATGIAGLSVAADSLSAIKYAQVKPIRNEEGLVVDFEIEGDFPKYGNNDDRVDDIAVDLVERFMTKLRSHKTYRDSEHTMSVLTITSNVVYGKKTGNTPDGRKAGEPFAPGANPMHGRDQKGALSSLSSVAKIPYDCCKDGISNTFSIVPKSLGKEPEDQNRNLTSMLDGYAMQCGHHLNINVFNRETLIDAMEHPEEYPQLTIRVSGYAVNFIKLTREQQLDVISRTFHESM

SEQ ID NO: 167 - protein, 251 aa, Staphylococcus aureus
MLKGHLHSVESLGTVDGPGLRYILFTQGCLLRCLYCHNPDTWKISEPSREVTVDEMVNEILPYKPYFDASGGGVTVSGGEPLLQMPFLEKLFAELKENGVHTCLDTSAGCANDTKAFQRHFEELQKHTDLILLDIKHIDNDKHIRLTGKPNTHILNFARKLSDMKQPVWIRHVLVPGYSDDKDDLIKLGEFINSLDNVEKFEILPYHQLGVHKWKTLGIAYELEDVEAPDDEAVKAAYRYVNFKGKIPVEL

SEQ ID NO: 168 - protein, 604 aa, Staphylococcus aureus
MKNIKMKLNIKAMRSVIMKRISKDIWAVFKLLYQNKGRFSINALLLQLIMIFISSTYLILLFNMMLKVAGQSQLTINNWTEIVSHPASVILLIIFILSVAFLIYVEFSLLVYMVYAGFDRQIITFKSIFKNAFVNVRKLIGVPVIFFVIYLMLMIPIANLGLSSVLTKNIYIPKFLTEELMKTTKGIIIYGTFMIAVFILNFKLIFTLPLTILNRQSLFKNMRLSWQITKRNKFRLVIEIVILELIIGAILTLIISGATYLAICVDEEGDKFLVSSILFVVLKSALFFYYLFTKLSLISVLVLHLKQENVLDQPGLEFKYPKPKRKSRFFIISMVLAVTCFIGYNMYLLYNNTINTNISIIGHRGFEDKGVENSIPSLKAAAKANVEYVELDTIMTKDKQFVVSHDNNLKRLTGVNKNISESNFKDIVGLKMRQNGHEAKFVSLDEFIETAKQSNVKLLVELKPHGKEPADYTQRVIDILKKHGVEHQYRVMSLDYDVMTKLKKEAPYLKCGYIIPLQFGHFKETSLDFFVIEDFSYSPRLVNQAHLENKEVYTWTINGEEDLTKYLQTNVDGIITDDPALADQIKEEKKDETYFDRSIRILFE

SEQ ID NO: 169 - protein, 114 aa, Staphylococcus aureus
MTTQMKIKTYLVAGIKAALLDTTGIKLASKSETTSHTYQHQALVDQLHELIANTDLNKLSYLNLDAFQKRDILAAHYIAKSAIRTKNLDQMTKAKQRLESIYNSISNPLHSQNN

SEQ ID NO: 170 - protein, 636 aa, Staphylococcus aureus
MKKQIISLGALAVASSLFTWDNKADAIVTKDYSGKSQVNAGSKNGTLIDSRYLNSALYYLEDYIIYAIGLTNKYEYGDNIYKEAKDRLLEKVLREDQYLLERKKSQYEDYKQWYANYKKENPRTDLKMANFHKYNLEELSMKEYNELQDALKRALDDFHREVKDIKDKNSDLKTFNAAEEDKATKEVYDLVSEIDTLVVSYYGDKDYGEHAKELRAKLDLILGDTDNPHKITNERIKKEMIDDLNSIIDDFFMETKQNRPKSITKYNPTTHNYKTNSDNKPNFDKLVEETKKAVKEADDSWKKKTVKKYGETETKSPVVKEEKKVEEPQAPKVDNQQEVKTTAGKAEETTQPVAQPLVKIPQGTITGEIVKGPEYPTMENKTVQGEIVQGPDFLTMEQSGPSLSNNYTNPPLTNPILEGLEGSSSKLEIKPQGTESTLKGTQGESSDIEVKPQATETTEASQYGPRPQFNKTPKYVKYRDAGTGIREYNDGTFGYEARPRFNKPSETNAYNVTTHANGQVSYGARPTYKKPSETNAYNVTTHANGQVSYGARPTQNKPSKTNAYNVTTHGNGQVSYGARPTQNKPSKTNAYNVTTHANGQVSYGARPTYKKPSKTNAYNVTTHADGTATYGPRVTK

SEQ ID NO: 171 - protein, 35 aa, Staphylococcus aureus
MCVRTRLVSSSSARLSKAIIIAVIVVYHLDVRGLF

SEQ ID NO: 172 - protein, 397 aa, Staphylococcus aureus
MITMQEAYIVAYGRSAAAKAKQGALFHERPDDVAAKVLQGVLKRIDGKFNKNMIEDVIVGTAFPEGLQGQNIARTIALRAGLSDTVPGQTVNRYCSSGLQTIAIAANQIMAGQGDILVAGGVELMSAVPMGGNEPTNNPTLQYDDIGASYPMGLTAENVASQFDVSREDQDAYAVRSHQRAYDAQRDGRFKDEIIPIQVNSVEYTNAGPKVHTNIFDQDEFIRPDTTMEALAKLRTVFKADGTMTAGTSAPLSDGAGFVVLMSGDKVKELGVTPIARFVGFKAVGVDPKIMGIGPAYAIPEVLSLSNLSVEDIDLIELNEAFASQTIASIKEVGLDISRTNVNGGAIALGHPLGATGAMLTARLLNEMGRRPDSRYGMVTMCIGVGMGAAAIFEYVR

SEQ ID NO: 173 - protein, 753 aa, Staphylococcus aureus
MTINKVTVLGAGTMGAQLAALFVNAGLKVKLLDIVVDKNDPNLIAKKSYDKITDKKRPLLFDLNLASHLTYGNFDDDLVNDDADLYIEAVKEDIEIKHAVWQQVLQHAKEDALFATNTSGIPINAIAQAFNEKDQERFFGLHFFNPPRIMKLVELIPTSHTKESIILDVKNFAQNVLGKGVIVVNDVPGFVANRVGTQTMNDIMYRAEQHKISIVDVDALTGQAIGRPKTGTYALSDLVGLDIAVSVIKGMQQVPEETPYFHDVKIVNTLFDNGALGRKTKQGFYKKDKETKARLVYDVEKQDYVPVSQPQLPILNEFNKDLVHNLDTIFNAQDEAGLFLWETLRNNFYYSAINVPKATDDFRDIDRALVWGFNWKLGPFQLWDAMGYERVKTRMEDELGDLPQWISDLDGGFYKQDETIEYATPISHFVKDELWDKGDAKLSVTHDDQLLLKLQSKNNVITDEFNDALVDAIDLLENDHYTSMVIYADGNNFSVGANLFLMKKAHEDGLVDDVVAQSIDKLHYSFNRLKYSLKPVVTAVQGRALGGGCELVLYSPIVVAASETYIGLVEAGVGLLPSGGGLAEMADRILRTSHKFDDKQASMTKVLTNIAFAKVSTNAFEARRYGYLRDTDTIIFNTAQRVEVALKRAKYEAETNYIPNPRHQYIALGEDFKALIQGQLDAQRRGHFISDHDYHIALNIATILAGGDLPRNTFINQRYIQSLEKIGFIDLLKSKKSYERIAHMLKTGKPLRN

SEQ ID NO: 174 - protein, 418 aa, Staphylococcus aureus
MHFTLVFILFLGGIYMTFEKETVLKTLFPEDVLSIAKGLTDGEVEFLQQVDSLLESKYRENINQHWIDATVPEDYFKDLGELNYFNNPLLYKDRPNAKMPSQLFQFFMSYLLARFDISLATLLGVHQGLGHNTFYFGGSKEQIAKYVPKLQSHELRTCFALTEPEHGSDVAGGLETVAERQGDTWVINGEKKWIGGAHVSDVIPVFAVNKETGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 175 - protein, 20 aa, Staphylococcus aureus
MNILFAITGIAFALFVAFLF

SEQ ID NO: 176 - protein, 307 aa, Staphylococcus aureus
MANLQKYIEYSREVQQARENNQPIVALESTIISHGMPYPQNVEMATTVEQIIRNNGAIPATIAIIDGKIKIGLESEDLEILATSKDVAKVSRRDLAEVIAMKCVGATTVATTMICAAMAGIQFFVTGGIGGVHKGAEHTMDISADLEELSKTNVTVICAGAKSILDLPKTMEYLETKGVPVIGYQTNELPAFFTRESGVKLTSSVETPERLADIHLTKQQLNLEGGIVVANPIPYEHALSKAYIEAIINEAVVEAENQGIKGKDATPFLLGKIVEKTNGKSLAANIKLVENNAALGAKIAVAVNKLL

SEQ ID NO: 177 - protein, 238 aa, Staphylococcus aureus
LDHVQQFENASTGSYTALISKEGDMTYGLADMEVFDYITPEFLIKRSHLLKKAKCIIVDLNLGKEALNFLCAYTTKHQIKLVITTVSSPKMKNMPDSLHAIDWIITNKDETETYLNLKIESTDDLKIAAKRWNDLGVKNVIVTNGVKELIYRSGEEEIIKSVMPSNSVKDVTGAGDSFCAAVVYSWLNGMSTEDILIAGMVNAKKTIETKYTVRQNLDQQQLYHDMEDYKNGKFTKVY

SEQ ID NO: 178 - protein, 129 aa, Staphylococcus aureus
VNEMVNEQIIDISGPLKGEIEVPGDKSMTHRAIMLASLAEGVSTIYKPLLGEDCRRTMDIFRLLGVEIKEDDEKLVVTSPGYQSFNTPHQVLYTGNSGTTTRLLAGLLSGLGIESVLSGDVSIGKRPMD

SEQ ID NO: 179 - protein, 354 aa, Staphylococcus aureus
MKLQTTYPSNNYPIYVEHGAIDHISTYIDQFDQSFILIDEHVNQYFADKFDDILSYENVHKVIIPAGEKTKTFEQYQETLEYILSHHVTRNTAIIAVGGGATGDFAGFIAATLLRGVHFIQVPTTILAHDSSVGGKVGINSKQGKNLIGAFYRPTAVIYDLVFLKTLPFEQILSGYAEVYKHALLNGESATQDIEQHFKDREILQSLNGMDKYIAKGIETKLDIVIADEKEQGVRKFLNLGHTFGHAVEYYHKIPHGHAVMVGIIYQFIVANALFDSKHDINHYIQYLIQLGYPLDMITDLDFETLYQYMLSDKKNDKQGVQMVLIRQFGDIVVQHVDQLTLQHACEQLKTYFK

SEQ ID NO: 180 - protein, 216 aa, Staphylococcus aureus
DFYDSETFKANLDRNDVRVIDDSIAQAMRDKIDEAKNEGDSIGGVVQVVVENMPVGVGSYVHYDRKLDGKIAQGVVSINAFKGVSFGEGFKAAEKPGSEIQDEILYNSEIGYYRGSNHLGGLEGGMSNGMPIIVNGVMKPIPTLYKPLNSVDINTKEDFKATIERSDSCAVPAASIVCEHVVAFEIAKALLEEFQSNHIEQLKQQIIERRQLNIEF

SEQ ID NO: 181 - protein, 106 aa, Staphylococcus aureus
DRPIQVGSHFHFYEANAALDFEREMAYGKHLDIPAGAAVRFEPGDKKEVQLVEYAGKRKIFGFRGMVNGPIDESRVYRPTDENDEYAGVFGDNGAENVNKKGGKRS

SEQ ID NO: 182 - protein, 431 aa, Staphylococcus aureus
MSFKMTQNQYTSLYGPTVGDSIRLGDTNLFAQIEKDYAVYGEEATFGGGKSIRDGMAQNPRVTRDDVNVADLVISNAVIIDYDKVVKADIGIKNGYIFAIGNAGNPDIMDNVDIIIGSTTDIIAAEGKIVTAGGIDTHVHFINPEQAEVALESGITTHIGGGTGASEGSKATTVTPGPWHIHRMLEAAEGLPINVGFTGKGQATNPTALIEQINAGAIGLKVHEDWGATPSALSHALDVADEFDVQIALHADTLNEAGFMEDTMAAVKDRVLHMYHTEGAGGGHAPDLIKSAAFSNILPSSTNPTLPYTHNTVDEHLDMVMITHHLNAAIPEDIAFADSRIRKETIAAEDVLQDMGVFSMISSDSQAMGRVGEVITRTWQVAHRMKEQRGPLDGDFEHNDNNRIKRYIAKYTINPAITHGISEYVGSIEPG

SEQ ID NO: 183 - protein, 137 aa, Staphylococcus aureus
MNEYRNKKGPDYSIFKNNWKVLLMDTSKTIFSKYRWNKSFKAYKRSSDIVEFMLSKDDILRHSYELVQGLRKDLRLCNWPKFINRLNSVSKKSVSKGVWKVVKYYRKHQRMLRNTIYYPAFNNGAIEGINNKIKLIK

SEQ ID NO: 184 - protein, 148 aa, Staphylococcus aureus
VKIMRVTELLTKDTIAMDLMANDKNGVIDELVNQLDKAGKLSDVASFKEAIHNRESQSTTGIGEGIAIPHAKVAAVKSPAIAFGKSKAGVDYQSLDMQPAHLFFMIAAPEGGAQTHLDALAKLSGILMDENVREKLLHASSPEEVLAI

SEQ ID NO: 185 - protein, 306 aa, Staphylococcus aureus
MIYTVTFNPSIDYVIFTNDFKIDGLNRATATYKFAGGKGINVSRVLKTLDVESTALGFAGGFPGKFIIDTLNNSAIQSNFIEVDEDTRINVKLKTGQETEINAPGPHITSTQFEQLLQQIKNTTSEDIVIVAGSVPSSIPSDAYAQIAQITAQTGAKLVVDAEKELAESVLPYHPLFIKPNKDELEVMFNTTVNSDTDVIKYGRLLVDKGAQSVIVSLGGDGAIYIDKEISIKAVNPQGKVVNTVGSGDSTVAGMVAGIASGLTIEKAFQQAVACGTATAFDEDLATRDAIEKIKSQVTISVLDGE

SEQ ID NO: 186 - protein, 226 aa, Staphylococcus aureus
DRTGCSASTIRRDLSKLQQLGKLQRVHGGAMLKENRMVEANLTEKLATNLDEKKMIAKIAANQINDNECLFIDAGSSTLELIKYIQAKDIIVVTNGLTHVEALLKKGIKTIMLGGQVKENTLATIGSSAMEILRRYCFDKAFIGMNGLDIELGLTTPDEQEALVKQTAMSLANQSFVLIDHSKFNKVYFARVPLLESTTIITSEKALNQESLKEYQQKYHFIGGTL

SEQ ID NO: 187 - protein, 46 aa, Staphylococcus aureus
GSPVLNSKHELIGILYAGSGKDESEKNFGVYFTPQLKEFIQNNIEK

SEQ ID NO: 188 - protein, 254 aa, Staphylococcus aureus
MYLDIKIIKREELKMNKNVVIKSLAALTILTSVTGIGTTLVEEVQQTAKAENNVTKVKDTNIFPYTGVVAFKSATGFVVGKNTILTNKHVSKNYKVGDRITAHPNSDKGNGGIYSIKKIINYPGKEDVSVIQVEERAIERGPKGFNFNDNVTPFKYAAGAKAGERIKVIGYPHPYKNKYVLYESTGPVMSVEGSSIVYSAHTESGNSGSPVLNSNNELVGIHFASDVKNDDNRNAYGVYFTPEIKKFIAENIDK

SEQ ID NO: 189 - protein, 241 aa, Staphylococcus aureus
LKMNKNIVIKSMAALAILTSVTGINAAVVEETQQIANAEKNVTQVKDTNIFPYNGVVSFKDATGFVIGKNTIITNKHVSKDYKVGDRITAHPNGDKGNGGIYKIKSISDYPGDEDISVMNIEEQAVERGPKGFNFNENVQAFNFAKDAKVDDKIKVIGYPLPAQNSFKQFESTGTIKRIKDNILNFDAYIEPGNSGSPVLNSNNEVIGVVYGGIGKIGSEYNGAVYFTPQIKDFIQKHIEQ

SEQ ID NO: 190 - protein, 247 aa, Staphylococcus aureus
MNKQRSTKMNKNIIIKSIAALTILTSITGVGTTVVDGIQQTAKAENSVKLITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVTSDAVVQPGSSGSPILNSKREAIGVMYASDKPTGESTRSFAVYFSPEIKKFIADNLDK

SEQ ID NO: 191 - protein, 238 aa, Staphylococcus aureus
MNKNIIIKSIAALTILTSVTGVGTTVVEGIQQTAKAEHNVKLIKNTNVAPYNGVVSIGSGTGFIVGKNTIVTNKHVVAGMEIGAHIIAHPNGEYNNGGFYKVKKIVRYSGQEDIAILHVEDKAVHPKNRNFKDYTGILKIASEAKENERISIVGYPEPYINKFQMYESTGKVLSVKGNMIITDAFVEPGNSGSAVFNSKYEVVGVHFGGNGPGNKSTKGYGVYFSPEIKKFIADNTDK

SEQ ID NO: 192 - protein, 239 aa, Staphylococcus aureus
MNKNIIIKSIAALTILTSITGVGTTMVEGIQQTAKAENTVKQITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 193 - protein, 146 aa, Staphylococcus aureus
MILKAFESYNISIKFFNNNCATKTQNFHHQHPNYQHRNITKCYNKSITQRDKLLMQRRRNHMSITEKQRQQQAELHKKLWSIANDLRGNMDASEFRNYILGLIFYRFLSEKAEQEYADALSGEDITYQEAWADEEYREDLKAELID

SEQ ID NO: 194 - protein, 180 aa, Staphylococcus aureus
SGTGFIVGKNTIVTNKHVVAGMEIGAHIIAHPNGEYNNGGFYKVKKIVRYSGQEDIAILHVEDKAVHPKNRNFKDYTGILKIASEAKENERISIVGYPEPYINKFQMYESTGKVLSVKGNMIITDAFVEPGNSGSAVFNSKYEVVGVHFGGNGPGNKSTKGYGVYFSPEIKKFIADNTDK

SEQ ID NO: 195 - protein, 239 aa, Staphylococcus aureus; identical to SEQ ID NO: 192

SEQ ID NO: 196 - protein, 317 aa, Staphylococcus aureus
MGNHFQYAFENKRYHTWNYHLKNKFGQKIFKVALDGGFDCPNRDGTVAHGGCTFCSAAGSGDFAGNRADSIAVQFKEIKEKMHEKWHEGKYIAYFQAFTNTHAPVEVLKEKFEPVLKEPGVVGLSIGTRPDCLPDDVVEYLADLNQRTYLWVELGLQTIHQSTSDLINRAHDMKTYYDGVAKLRKHNINVCTHIINGLPGEDYDMMMATAKEVAQMDVQGIKIHLLHLLKGTPMVKQYDKGLLTFMTQEEYTNLVVDQLEVIPPEMIVHRITGDGPIDIMVGPMWSVNKWEVLNGIDAELARRNSYQGLRYKSKVKQ

SEQ ID NO: 197 - protein, 393 aa, Staphylococcus aureus
MNIPKSVWWLVIGMALNITGSSFLWPLNTIYMKQELGKSLTVAGLVLMINSFGMVIGNLLGGSLFDKLGGYKTILIGTFTCLCSTTLLNFFHGWPWYAVWLVMLGFGGGMIIPAIYAMAGAVWPNGGRQTFNAIYLAQNIGVAVGAAMGGFVAEFSFNYIFLANLIMYVVFALVAVTQFNIEINAKVKYPTHLDITGKKNKARFISLVLICAMFAICWVAYIQWESTIASFTQSINISMAQYSVLWTINGIMILVAQPLIKPILYLLKGNLKKQMFVGIIIFMLSFFVTSFAENFTIFVVGMIILTFGEMFVWPAVPTIANQLAPDGKQGQYQGFVNSAATVGKAFGPFLGGVLVDAFNMRMMFIGMMLLLVFALILLMVFKENNTQPKKIDA

SEQ ID NO: 198 - protein, 805 aa, Staphylococcus aureus
VLNYNHNQIEKKWQDYWDENKTFKTNDNLGQKKFYALDMFPYPSGAGLHVGHPEGYTATDIISRYKRMQGYNVLHPMGWDAFGLPAEQYALDTGNDPREFTKKNIQTFKRQIKELGFSYDWDREVNTTDPEYYKWTQWIFIQLYNKGLAYVDEVAVNWCPALGTVLSNEEVIDGVSERGGHPVYRKPMKQWVLKITEYADQLLADLDDLDWPESLKDMQRNWIGRSEGAKVSFDVDNTEGKVEVFTTRPDTIYGASFLVLSPEHALVNSITTDEYKEKVKAYQTEASKKSDLERTDLAKDKSGVFTGAYATNPLSGEKVQIWIADYVLSTYGTGAIMAVPAHDDRDYEFAKKFDLPIIEVIEGGNVEEAAYTGEGKHINSGELDGLENEAAITKAIQLLEQKGAGEKKVNYKLRDWLFSRQRYWGEPIPVIHWEDGTMTTVPEEELPLLLPETDEIKPSGTGESPLANIDSFVNVVDEKTGMKGRRETNTMPQWAGSCWYYLRYIDPKNENMLADPEKLKHWLPVDLYIGGVEHAVLHLLYARFWHKVLYDLAIVPTKEPFQKLFNQGMILGEGNEKMSKSKGNVINPDDIVQSHGADTLRLYEMFMGPLDAAIAWSEKGLDGSRRFLDRVWRLMVNEDGTLSSKIVTTNNKSLDKVYNQTVKKVTEDFETLGFNTAISQLMVFINECYKVDEVYKPYIEGFVKMLAPIAPHIGEELWSKLGHEESITYQPWPTYDEALLVDDEVEIVVQVNGKLRAKIKIAKDTSKEEMQEIALSNDNVKASIEGKDIMKVIAVPQKLVNIVAK

SEQ ID NO: 199 - protein, 253 aa, Staphylococcus aureus
MAYISLNYHSPTIGMHQNLTVILPEDQSFFNSDTTVKPLKTLMLLHGLSSDETTYMRYTSIERYANEHKLAVIMPNVDHSAYANMAYGHSYYDYILEVYDYVHQIFPLSKKRDDNFIAGHSMGGYGTIKFALTQGDKFAKAVPLSAVFEAQNLMDLEWNDFSKEAIIGNLSSVKGTEHDPYYLLDKAVAEDKQIPKLLIMCGKQDFLYQDNLDFIDYLSRINVPYQFEDGPGDHDYAYWDQAIKRAITWMVND

SEQ ID NO: 200 - protein, 877 aa, Staphylococcus aureus
LKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 201 - protein, 234 aa, Staphylococcus aureus
MTENFILGRNNKLEHELKALADYINIPYSILQPYQSECFVRHYTKGQVIYFSPQESSNIYFLIEGNIIREHYNQNGDVYRYFNKEQVLFPISNLFHPKEVNELCTALTDCTVLGLPRELMAFLCKANDDIFLTLFALINDNEQQHMNYNMALTSKFAKDRIIKLICHLCQTVGYDQDEFYEIKQFLTIQLMSDMAGISRETAGHIIHELKDEKLVVKDHKNWLVSKHLFNDVCV

SEQ ID NO: 202 - protein, 697 aa, Staphylococcus aureus
MQKAFRNVLVIVIIGVIIFGLFSYLNGNGNMPKQLTYNQFTEKLEKGDLKTLEIQPQQNVYMVSGKTKNDEDYSSTILYNNEKELQKITDAAKKQNGVKLTIKEEEKQSVFVSILSTLIPVVVIALLFIFFLSQAQGGGSGGRMMNFGKSKAKMYDNNKRRVRFSDVAGADEEKQELIEIVDFLKDNKKFKEMGSRIPKGVLLVGPPGTGKTLLARAVAGEAGAPFFSISGSDFVEMFVGVGASRVRDLFDNAKKNAPCIIFIDEIDAVGRQRGAGVGGGHDEREQTLNQLLVEMDGFGENEGIIMIAATNRPDILDPALLRPGRFDRQIQVGRPDVKGREAILHVHAKNKPLDETVDLKAISQRTPGFSGADLENLLNEASLIAVREGKKKIDMRDIEEATDRVIAGPAKKSRVISKKERNIVAHHEAGHTIIGMVLDEAEVVHKVTIVPRGQAGGYAMMLPKQDRFLMTEQELLDKICGLLGGRVSEDINFNEVSTGASNDFERATQIARSMVTQYGMSKKLGPLQFGHSNGQVFLGKDMQGEPNYSSQIAYEIDKEVQRIVKEQYERCKQILLEHKEQLILIAETLLTEETLVAEQIQSLFYEGKLPEIDYDAAKVVKDEDSEFNDGKFGKSYEEIRKEQLEDGQRDESEDRKEEKDIAEDKKEADKSDEKDEPAHRQAPNIEKPYDPNHPDNK

SEQ ID NO: 203 - protein, 293 aa, Staphylococcus aureus
MTHDYIVKALAFDGEIRAYAALTTETVQEAQTRHYTWPTASAAMGRTMTATAMMGAMLKGDQKLTVTVDGQGPIGRIIADANAKGEVRAYVDHPQTHFPLNEQGKLDVRRAVGTNGSIMVVKDVGMKDYFSGASPIVSGELGEDFTYYYATSEQTPSSVGLGVLVNPDNTIKAAGGFIIQVMPGAKDETISKLEKAISEMTPVSKLIEQGLTPEGLLNEILGEDHVQILEKMPVQFECNCSHEKFLNAIKGLGEAEIQNMIKEDHGAEAVCHFCGNKYKYTEEELNVLLESLA

SEQ ID NO: 204 - protein, 412 aa, Staphylococcus aureus
DQLDVVNRWRQNETYKTMAVPLGVRGKDDILSLNLHEKAHGPHGLVAGTTGSGKSEIIQSYILSLAINFHPHEVAFLLIDYKGGGMANLFKDLVHLVGTITNLDGDEAMRALTSIKAELRKRQRLFGEHDVNHINQYHKLFKEGIATEPMPHLFIISDEFAELKSEQPDFMKELVSTARIGRSLGIHLILATQKPSGVVDDQIWSNSKFKLALKVQDRQDSNEILKTPDAADITLPGRAYLQVGNNEIYELFQSAWSGATYDIEGDKLEVEDKTIYMINDYGQLQAINKDLSGLEDEETKENQTELEAVIDHIESITTRLEIEEVKRPWLPPLPENVYQEDLVETDFRKLWSDDAKEVELTLGLKDVPEEQYQGPMVLQLKKAGHIALIGSPGYGRTTFLHNIIFDVARHHR

SEQ ID NO: 205 - protein, 85 aa, Staphylococcus aureus
VINMLYLEVLKNRNFTYLLIGNFLRRSCFVLFSLQIIWFTVELTNQSSLKLSMMVMSQTLPFIIFGIFGGAYSDKHNKKKILYLS

SEQ ID NO: 206 - protein, 1117 aa, Staphylococcus aureus
DPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 207 - protein, 130 aa, Staphylococcus aureus
MNLFFNTRNVTTKGVYNMKKSKRLEIVSTIVKKHKIYKKEQIISYIEEYFGVRYSATTIAKDLKELNIYRVPIDCETWIYKAINNQTEQEMREKFRHYCEHEVLSSIINGSYIIVKTSPGFAQGINYFID

SEQ ID NO: 208 - protein, 254 aa, Staphylococcus aureus
QATLITNEDENFVKDEQRAGVDANYYAKQTYDYYKDTFGRESYDNQGSPIVSLTHVNNYGGQDNRNNAAWIGDKMIYGDGDGRTFTSLSGANDVVAHELTHGVTQETANLEYKDQSGALNESFSDVFGYFVDDEDFLMGEDVYTPGKEGDALRSMSNPEQFGQPAHMKDYVFTEKDNGGVHTNSGIPNKAAYNVIQAIGKSKSEQIYYRALTEYLTSNSNFKDCKDALYQAAKDLYDEQTAEQVYEAWNEVGVE

SEQ ID NO: 209 - protein, 350 aa, Staphylococcus aureus
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 210 - protein, 227 aa, Staphylococcus aureus
LKNILKVFNTTILALIIIIATFSNSANAADSGTLNYEVYKYNTNDTSIANDYFNKPAKYIKKNGKLYVQITVNHSHWITGMSIEGHKENIISKNTAKDERTSEFEVSKLNGKIDGKIDVYIDEKVNGKPFKYDHHYNITYKFNGPTDVAGANAPGKDDKNSASGSDKGSDGTTTGQSESNSSNKDKVENPQTNAGTPAYIYAIPVASLALLIAITLFVRKKSKGNVE

SEQ ID NO: 211 - protein, 98 aa, Staphylococcus aureus
NSYLSDEVTRVGRGTLRKIGPKDRIIKPLTYLYNKDLERTGLLNTAALLLKYDDTADQETVEKNNYIKEHGLKAFLSEYAKVDDGLADEIIEAYNSLS

SEQ ID NO: 212 - protein, 1448 aa, Staphylococcus aureus
AVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 213 - protein, 44 aa, Staphylococcus aureus
MKKEIKMAINIIEYNRSYKEELIEFILSIQKNEFNIKIDRDDQP

SEQ ID NO: 214 - protein, 233 aa, Staphylococcus aureus
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 215 - protein, 138 aa, Staphylococcus aureus
SASIGISATEAVLIIGTSKVNRLGVPLSVFFGGVKMMIPNMVKYPILMLPILTTAIVSGLVSALVGIHGTKESAGFGFIGMVGPINAFKFMEVDSAWLSVLLIVVAFFVVPFVTAWLADIIYRKVFRLYTNDIFKFMG

SEQ ID NO: 216 - protein, 567 aa, Staphylococcus aureus
LKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPD

SEQ ID NO: 217 - protein, 17 aa, Staphylococcus aureus
DHKNWLVSKHLFNDVCV

SEQ ID NO: 218 - protein, 376 aa, Staphylococcus aureus
ILVVLNLFLAWFFIYFDWGQKAVRGAANGIAWVVQSAHAGTGFAFASLTNVKMMDMAVAALFPILLIVPLFDILMYFNILPKIIGGIGWLLAKVTRQPKFESFFGIEMMFLGNTEALAVSSEQLKRMNEMRVLTIAMMSMSSVSGAIVGAYVQMVPGELVLTAIPLNIVNAIIVSCLLNPVSVEEKEDIIYSLKNNEVERQPFFSFLGDSVLAAGKLVLIIIAFVISFVALADLFDRFINLITGLIAGWIGIKGSFGLNQILGVFMYPFALLLGLPYDEAWLVAQQMAKKIVTNEFVVMGEISKDIASYTPHHRAVITTFLISFANFSTIGMIIGTLKGIVDKKTSDFVSKYVPMMLLSGILVSLLTAAFVGLFAW

SEQ ID NO: 219 - protein, 49 aa, Staphylococcus aureus
MRISMEGFSVINFDNFKKYQESFGYMAQQLCFPEKLTFHPKTFEETISK

SEQ ID NO: 220 - protein, 519 aa, Staphylococcus aureus
LKIKAQVAMVLNLDKCIGCHTCSVTCKNTWTNRPGAEYMWFNNVETKPGVGYPKRWEDQEHYKGGWVLNRKGKLELKSGSRISKIALGKIFYNPDMPLIKDYYEPWNYNYEHLTTAKSGKHSPVARAYSEITGDNIEIEWGPNWEDDLAGGHVTGPKDPNIQKIEEDIKFQFDETFMMYLPRLCEHCLNPSCVASCPSGAMYKRDEDGIVLVDQDACRGWRYCMTGCPYKKVYFNWKTNKAEKCTFCFPRIEAGMPTVCSETCTGRMRYLGVLLYDADRVHEAASAVDEKDLYEKQLDIFLNPFDEEVIAQAEKDGIGYDWIEAAQNSPIYKLAIEYKLAFPLHPEFRTMPMVWYCPPLSPIMSYFEGKNTTQNPDAIFPAIEEMRLPIEYLANIFTAGDTEPVKGALQRMAMMRSYMRSQVTQQPFDTSRLERLGITERQTKDMYRLLGLAKYEDRFVIPTSHKETYLDTYHAQGSTGYNYGGEHFGDNCEGCGVAVGSGKTGQEIYNENFYGGIFRD

SEQ ID NO: 221 - protein, 189 aa, Staphylococcus aureus
DHEVFQQFGESLPVYKPTLPPMVFGNRDKKIKGGTDALVLRYLTPHGKWNIHSMYQDNKHMLTLFRGGPTVWISNEDAEKHDIQDNDWLEVYNRNGVVTARAVISHRMPKGTMFMYHAQDKHIQTPGSEITDTRGGSHNAPTRIHLKPTQLVGGYAQISYHFNYYGPIGNQRDLYVAVRKMKEVNWLED

SEQ ID NO: 222 - protein, 79 aa, Staphylococcus aureus
MTNQFKNKQSKLHDSLESITKNLYATPTSELPFDNRFLFKSFILKRETGNIVIYHSGHLGDSQQDIASLGGVSKVLMNH

SEQ ID NO: 223 - protein, 540 aa, Staphylococcus aureus
LKKEKVMDWTTFIGTVAVLLFAVIPMMAFPKASEDIITGINSAISDSIGSIYLFMGLAIFCFVMYIAFGKYGNVTLGKASDKPEFNTFTWAAMLFCAGIGSDILYWGVIEWAFYYQVPPNGAKSMSDEALQYATQYGMFHWGPIAWAIYVLPALPIGYLVFVKKQPVYKISQACRPILKGQTDKFVGKVVDILFIFGLLGGAATSLALGVPLISAGIERLTGLDGKNMILRSAILLTITVIFAISSYTGLKKGIQKLSDINVWLSFVLLAFIFIIGPTVFIMETTVTGFGNMLRDFFHMATWLEPFGGIKGRKETNFPQDWTIFYWSWWLVYAPFIGLFIARISKGRRLKEVVLGTIIYGTLGCVLFFGIFGNYAVYLQISGQFNVTQYLNTHGTEATIIEVVHHLPFPSLMIVLFLVSAFLFLATTFDSGSYILAAASQKKVVGEPLRANRLFWAFALCLLPFSLMLVGGERALEVLKTASILASVPLIVIFIFMMISFLIILGRDRIKLETRAEKLKEVERRSLRIVQVSEEEQDDNL

SEQ ID NO: 224 - protein, 70 aa, Staphylococcus aureus
DHCYECDYDGDFEATEKGFKCPNCGNDNPKTVDVVKRTCGYLGNPVQRPVIKGRHKEICARVKHMKAPKE

SEQ ID NO: 225 - protein, 174 aa, Staphylococcus aureus
LISMEWILFDKDGTLIEFDRSWEKIGVRFVQSLLETFPVHNKEAALRQLGVIKESIDPKSVMGSGSLQQIIQAFNDVTGQDTTDWSKSTSQKLVDERIPEINWVEGVKEALIDLKAKGYQLGIVTSDTKKGVEQFLAHTNATSLFDLIISTEADAYEKPNPKVLSPLFEQYNVD

SEQ ID NO: 226 - protein, 57 aa, Staphylococcus aureus
LESRCTKILIKIEYNHENNMQKLIMTKIPFNEAKHGNKLSLQCLLLSIEGDFTYYYI

SEQ ID NO: 227 - protein, 358 aa, Staphylococcus aureus
MSQAVKVERRETLKQKPNTSQLGFGKYFTDYMLSYDYDADKGWHDLKIVPYGPIEISPAAQGVHYGQSVFEGLKAYKRDGEVALFRPEENFKRLNNSLARLEMPQVDEAELLEGLKQLVDIERDWIPEGEGQSLYIRPFVFATEGALGVGASHQYKLLIILSPSGAYYGGETLKPTKIYVEDEYVRAVRGGVGFAKVAGNYAASLLAQTNANKLGYDQVLWLDGVEQKYIEEVGSMNIFFVENGKVITPELNGSILPGITRKSIIELAKNLGYEVEERRVSIDELFESYDKGELTEVFGSGTAAVISPVGTLRYEDREIVINNNETGEITQKLYDVYTGIQNGTLEDKNGWRVVVPKY

SEQ ID NO: 228 - protein, 27 aa, Staphylococcus aureus
DPKYDLASMTKLMLEAIEQKDTVKNNN

SEQ ID NO: 229 - protein, 73 aa, Staphylococcus aureus
MSFASEMKNELTRIDVDEMNAKAELSALIRMNGALSLSNQQFVINVQTENATTARRIYSLIKRVFNVEVEILV

SEQ ID NO: 230 - protein, 314 aa, Staphylococcus aureus
MSFASEMKNELTRIDVDEMNAKAELSALIRMNGALSLSNQQFVINVQTENATTARRIYSLIKRVFNVEVEILVRKKMKLKKNNIYICRTKMKAKEILDELGILKDGIFTHEIDHSMIQDDEMRRSYLRGAFLAGGSVNNPETSSYHLEIFSQNESHAEGLTKLMNSYELNAKHLERKKGSITYLKEAEKISDFLSLIGGYQALLKFEDVRIVRDMRNSVNRLVNCETANLNKTVSAAMKQVESIKLIDKEIGIENLPDRLREIARIRVEHQEISLKELGEMVSTGPISKSGVNHRLRKLNDLADKIRNGEQIEL

SEQ ID NO: 231 - protein, 178 aa, Staphylococcus aureus
SLINAINDEREHLSQIRSIANFVIDTTKLSPKELKERIRRYYEDEEFETFTINVTSFGFKHGIQMDADLVFDVRFLPNPYYVVDLRPLTGLDKDVYNYVMKWKETEIFFEKLTDLLDFMIPGYKKEGKSQLVIAIGCTGGQHRSVALAERLGNYLNEVFEYNVYVHHRDAHIESGEKK

SEQ ID NO: 232 - protein, 9 aa, Staphylococcus aureus
DQLIAKYDL

SEQ ID NO: 233 - protein, 513 aa, Staphylococcus aureus
MLPMKEVGFGTLNWVAVIIYLLAMLFIGVYFTKRASQSTNSFFTASGRLPSWVVGFSIYATTLSAITFMSTPEKAFLTDWSYIAGNIAIVAIIPLLIYFYVPFFKKLKVTSAYEYLEARFGPSIRVIGSLLFVVYHLGRVAIVIYLPTLAITSVSDMNPYIVASLVGLLCILYTFLGGFEGVVWSDFIQGVILLGGALVIIILGVVNIKGGFGTVFADAIEHKKLISADNWKLNTAAAAIPIIFLGNIFNNLYQYTASQDVVQRYQASDSLKETNKSLWTNGILALISAPLFYGMGTMLYSFYTHEAVLPKGFNTSSVVPYFILTEMPPFVAGLLIAAIFAAAQSTISSSLNSISACISIDIKQRFFGKGSERHEVNFARFIIIIAGIFGFGMSLYLIASNSNDLWDLFLFVTGLFGVPLAGVFAVGIFTKRTNTFGVICGLILGIIFAYVYNGVGKGNSPFYVSTISFTVAFVFAYILSFIVPSKHKKDITGLTIFEKDKPSTYISKTATKK

SEQ ID NO: 234 - protein, 337 aa, Staphylococcus aureus
SKAGINFVFGDIQNKNGFTFFLNVLLPLVFISVLIGIFNYIKVLPFIIKYVGIAINKITRMGRLESYFAISTAMFGQPEVYLTIKDIIPRLSRAKLYTIATSGMSAVSMAMLGSYMQMIEPKFVVTAVMLNIFSALIIASVINPYKSDDTDVEIDNLTKSTETKTLNGKTGKPKKVAFFQMIGDSAMDGFKIAVVVAVMLLAFISLMEAINIMFGSVGLNFKQLIGYVFAPIAFLMGIPWSEAVPAGSLMATKLITNEFVAMLDFKNVLGDVSARTQGIISVYLVSFANFGTVGIIVGSIKGISDKQGEKVASFAMRLLLGSTLASIISGSIIGLVL

SEQ ID NO: 235 - protein, 390 aa, Staphylococcus aureus
PLSSLNPRLTIGKQITEVIFQHKRVSKSEAKSMTIDILEKVGIKHATRQFDAYPHELSGGMRQRVMIAMALILKPQILIADEPTTALDASTQNQLLQLMKSLYEYTETSIIFITHDLGAVYQFCDDVIVMKDGSVVESGTVESIFKSPQHTYTKRLIDAIPDIHQTRPPRPLNNDILLKFDRVSVDYTSPSGSLYRAVNDINLAIRKGETLGIVGESGSGKSTLAKTVVGLKEVSEGFIWYNELPLSLFKDDELKSLRQEIQMIFQDPFASINPRFKVIDVIKRPLIIHGKVKDNDDIIKTVVSLLEKVGLDQTFLYRYPHELSGGQRQRVSIARALAVEPKVIVCDEAVSALDVSIQKDIIELLKQLQLDFGITYLFITHDMGVINEIC

SEQ ID NO: 236 - protein, 59 aa, Staphylococcus aureus
DQRYYTGSRDENVLSQKLPMSLIHEGVGEVVFDSKGVFNKGTKVVMVPNTPTEKDDVIA

SEQ ID NO: 237 - protein, 85 aa, Staphylococcus aureus; identical to SEQ ID NO: 205

SEQ ID NO: 238 - protein, 1116 aa, Staphylococcus aureus
PKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 239 - protein, 405 aa, Staphylococcus aureus
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIG

SEQ ID NO: 240 - protein, 280 aa, Staphylococcus aureus
ETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 241 - protein, 227 aa, Staphylococcus aureus; identical to SEQ ID NO: 210

SEQ ID NO: 242 - protein, 246 aa, Staphylococcus aureus
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQ

SEQ ID NO: 243 - protein, 106 aa, Staphylococcus aureus
DQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 244 - protein, 645 aa, Staphylococcus aureus
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 245 - protein, 43 aa, Staphylococcus aureus
MAVPKRRTSKTRKNKRRTHFKISVPGMTECPNCGRIQIITPCM

SEQ ID NO: 246 - protein, 32 aa, Staphylococcus aureus
MSLLNSKQQDDSESRQVDPRLQKLQQLYDKEQ

SEQ ID NO: 247 - protein, 116 aa, Staphylococcus aureus
  MISC_FEATURE (2)..(5): Xaa is disclosed as "."
LXXXXQLVIHITGTYTMPCARTLVPVKVPLDVTTTEVFDLEGYNQYNDDQDDVDEHYHIIKDGMVNLQDIVEDIVIIEKPMRAYSEQSDQMLTVGNGWEVIDEDQLDELAKQQATR

SEQ ID NO: 248 - protein, 1126 aa, Staphylococcus aureus
DPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNANVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVD

SEQ ID NO: 249 - protein, 239 aa, Staphylococcus aureus
DQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNID

SEQ ID NO: 250 - protein, 25 aa, Staphylococcus aureus
DPLMLDESLVDIESLSDALMLIESN

SEQ ID NO: 251 - protein, 323 aa, Staphylococcus aureus
VLRLVEPLKDIDPLNESESLVLVESLIDIESLSEVDSLTLSEPLNDVEVLNEPDVLVEVEPLVDFESLNESDSLTLSELLSDVDTLNDDESLVLTESLIDCEQLNELDSLTLSDFLNDVETLNEPESLTLVEPLIDLESLSELDSLTLSESFTDSDILCESDMLALITSLADVDVLVESLNDIDTLIEPDVLALVESDVESLTLSDNDVESLILVDVLVESDILCESLVLVRIEVLVEADVLRESLVDVDVLADPDALVLLDVLCESLNDVDVESDSLVLSDVEPDSDVLTDVDKLAMVDMRFEVDVLSESLNDADVLCESDS

SEQ ID NO: 252 - protein, 761 aa, Staphylococcus aureus
ESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISG

SEQ ID NO: 253 - protein, 564 aa, Staphylococcus aureus
MTTTFIISYIILALIIVGVINLFLIRSRKKGKRQQKEQQFTTRQSNQSKFKASDLDKTTDQSTQRMTHEELRVDNQDDHSQVSLNGYTKGSEKDQEAFTNNKDEEAVAAKNPESEEYKVNEKIKKEHKNFIFGEGVSRGKILAALLFGMFIAILNQTLLNVALPKINTEFNISASTGQWLMTGFMLVNGILIPITAYLFNKYSYRKLFLVALVLFTIGSLICAISMNFPIMMVGRVLQAIGAGVLMPLGSIVIITIYPPEKRGAAMGTMGIAMILAPAIGPTLSGYIVQNYHWNVMFYGMFIIGIIAILIGFVWFKLYQYTTNPKADIPGIIFSTIGFGALLYGFSEAGNKGWGSVEIETMFAIGIIFIILFVIRELRMKSPMLNLEVLKFPTFTLTTIINMVVMLSLYGGMILLPIYLQNLRGFSALDSGLLLLPGSLIMGLLGPFAGKLLDTIGLKPLAIFGIAVMTYATWELTKLNMDTPYMTIMGIYVLRSFGMAFIMMPMVTAAINALPGRLASHGNAFLNTMRQLAGSIGTAILVTVMTTQTTQHLSAFGEELDKTNP

SEQ ID NO: 254 - protein, 125 aa, Staphylococcus aureus
MPQKGTIAKLDGMEGSMVQAGNPIAYAYNLDDLYVTANIDEKDIKDVEVGKDVDVTIDGQKASIKGKVDSIGKATAASFSLMPSSNSDGNYTKVSQVIPVKITLESEPSKQVVPGMNAEVKIHKN

SEQ ID NO: 255 - protein, 341 aa, Staphylococcus aureus
MKLTVVGLGYIGLPTSIMFAKHGVDVLGVDINQQTIDKLQSGQISIEEPGLQEVYEEVLSSGKLKVSTTPDASDVFIIAVPTPNNDDQYRSCDISLVMRALDSILSFLEKGNTIIVESTIAPKTMDDFVKPVIENLGFTIGEDIYLVHCPERVLPGKILEELVHNNRIIGGVTEACIEAGKRVYRTFVQGEMIETDARTAEMSKLMENTYRDVNIALANELTKICNNLNINVLDVIEMANKHPRVNIHQPGPGVGGHCLAVDPYFIIAKDPENAKLIQTGREINNSMPAYVVDTTKQIIKVLSGNKVTVFGLTYKGDVDDIRESPAFDIYELLNQEPDIEV

SEQ ID NO: 256 - protein, 295 aa, Staphylococcus aureus
MRKNILITGVHGYIGNALKDKLIEQGHQVDQINVRNQLWKSTSFKDYDVLIHTAALVHNNSPQARLSDYMQVNMLLTKQLAQKAKAEDVKQFIFMSTMAVYGKEGHVGKSDQVDTQTPMNPTTNYGISKKFAEQALQELISDSFKVAIVRPPMIYGAHCPGNFQRLMQLSKRLPIIPNINNQRSALYIKHLTAFIDQLISLEVTGVYHPQDSFYFDTSSVMYEIRRQSHRKTVLINMPSMLNKYFNKLSVFRKLFGNLIYSNTLYENNNALEIIPGKMSLVIADIMDETTTKDKA

SEQ ID NO: 257 - protein, 185 aa, Staphylococcus aureus
MKRLFDVVSSIYGLVVLSPILLITALLIKMESPGPAIFKQKRPTINNELFNIYKFRSMKIDTPNVATDLMDSTSYITKTGKVIRKTSIDELPQLLNVLKGEMSIVGPRPALYNQYELIEKRTKANVHTIRPGVTGLAQVMGRDDITDDQKVAYDHYYLTHQSMMLDMYIIYKTIKNIVTSEGVHH

SEQ ID NO: 258 - protein, 11 aa, Staphylococcus aureus
INTMKYYNLLK

SEQ ID NO: 259 - protein, 39 aa, Staphylococcus aureus
MKLKRLFKTSSMTLVKKKLLTMPMAKREIIMFDDKILLI

SEQ ID NO: 260 - protein, 638 aa, Staphylococcus aureus
LLMIKKFLNECHNKIINRKDGLGYKQQMRGFMAHLSVKLRLLILALIDSLIVTFSVFVSYYILEPYFKTYSVKLLILAAISLFISHHISAFIFNMYHRAWEYASVSELILIVKAVTTSIVITMVVVTIVTGNRPFFRLYLITWMMHLILIGGSRLFWRIYRKYLGGKSFNKKPTLVVGAGQAGSMLIRQMLKSDEMKLEPVLAVDDDEHKRNITITEGVKVQGKIADIPELVRKYKIKKIIIAIPTIGQERLKEINNICHMDGVELLKMPNIEDVMSGELEVNQLKKVEVEDLLGRDPVELDMDMISNELTNKTILVTGAGGSIGSEICRQVCNFYPERIILLGHGENSIYLINRELRNRFGKNVDIVPIIADVQNRARMFEIMETYKPYAVYHAAAHKHVPLMEDNPEEAVRNNILGTKNTAEAAKNAEVKKFVMISTDKAVNPPNVMGASKRIAEMIIQSLNDETHRTNFVAVRFGNVLGSRGSVIPLFKSQIEEGGPVTVTHPEMTRYFMTIPEASRLVLQAGALAEGGEVFVLDMGEPVKIVDLARNLIKLSGKKEDDIRITYTGIRPGEKMFEELMNKDEVHPEQVFEKIYRGKVQHMKCNEVEAIIQDIVNDFSKEKIINYANGKKGDNYVR

SEQ ID NO: 261 - protein, 136 aa, Staphylococcus aureus
DQLFFELQSKGFVPIIAHPERNKAISQNLDILYDLINKGALSQVTTASLAGISGKKIRKLAIQMIENNLTHFIGSDAHNTEIRPFLMKDLFNDKKLRDYYEDMNGFISNAKLVVDDKKIPKRMPQQDYKQKRWFGL

SEQ ID NO: 262 - protein, 77 aa, Staphylococcus aureus
SKSYDERFTPDEVVAYQQHQGNKFKEHFDLNCYLTLLDVLDSHNIDRGRTDVTHVFKNLETKVLTMGFIDDLLYPDD

SEQ ID NO: 263 - protein, 75 aa, Staphylococcus aureus
HTGKVLLVTEDNLEGSIMSEVSAIIAEHCLFDLDAPIMRLAAPDVPSMPFSPVLENEIMMNPEKILNKMRELAEF

SEQ ID NO: 264 - protein, 424 aa, Staphylococcus aureus
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTSTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 265 - protein, 149 aa, Staphylococcus aureus
VIELMDMNFDLYMNGVVEQARNEIESAGYEQLTTAEDVDKVLKQDGTTLVMINSVCGCAGGIARPAASHALHYDVLPDRLVTVFAGQDKEATQRAREYFEGYAPSSPSFALVKDGKITEMIERHQIEGHDVMNVINQLQTLFNKYCEER

SEQ ID NO: 266 - protein, 244 aa, Staphylococcus aureus
MLKLNPYKIGFRTIKTAVGMTLGVIISKLLGLDNYASSAILVVLCIKHTKVHSLQAIISRLVSCFLVLFLGSAIFSLLGQSPIVLGIIVLLFIPLTVVLKVQEGVITSCVILLHVFNAKSIDAHLIVNETLLLLIGLSIAFTMNLMMPSLDKQLDEYKCKIEQQIADIFSKYSYICEKYEDTIAIEFEVLLLNIKKAKSIAFRDVKNHFVRNENSYYHYFDMREEQVELLMRMKPLIESICHKD

SEQ ID NO: 267 - protein, 54 aa, Staphylococcus aureus
DLRVLMDAIYELNDHQDLREITKDSKMQKLALAGFLKKIKGTYIESLLKEHKLL

SEQ ID NO: 268 - protein, 328 aa, Staphylococcus aureus
MEMSVTEVIFSFLGGLGIFLYGLKIMGDGLQASAGDRLRDILNKFTSNPVLGVIAGIVVTILIQSSSGTTVITIGLVTAGFMTLKQAIGVIMGANIGTTVTAFIIGIDLGEYAMPILALGAFLIFFFKRSKINNIGRILFGFGSLFFGLEFMGDAVKPLASLDGFKQLMLDMSTNPILAVIVGAGLTALVQSSSATIGILQEFYQQDLISLNAAIPVLLGDNIGTTITAILASLAGSIAAKRAALVHVIFNLIGVIIFTIFLPVVIHLISLLQDLWHLKPAMTIAVSHGIFNITNTLIQLPFVAGLAWIVTKLVPGKDIADDYKPQHL

SEQ ID NO: 269 - protein, 182 aa, Staphylococcus aureus
MPELPEVEHVKRGIEPYVINQKIEHVIFSDKVIEGKAQGKETIIKGIELDTFKTLSEGYTITNVERRSKYIVFQLDNKREQRTLISHLGMAGGFFIVDELEDIMIPNYRKHWHVIFELSNDKKLIYSDIRRFGEIRNVASVASYPSFLEIAPEPFSNEALTYYLNRIHQQSNKNKPIKQVIL

SEQ ID NO: 270 - protein, 47 aa, Staphylococcus aureus
DELIFEVPKSEVDSFSEFVEEIMENALQLDVPLKVDSSYGATWYDAK

SEQ ID NO: 271 - protein, 174 aa, Staphylococcus aureus
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQ

SEQ ID NO: 272 - protein, 449 aa, Staphylococcus aureus
LETSTIISLIIFILLIALTTVFVGSEFALVKIRATRIEQLADEGNKPAKIVKKMIANLDYYLSACQLGITVTSLGLGWLGEPTFEKLLHPIFEAINLPTALTTTISFAVSFIIVTYLHVVLGELAPKSIAIQHTEKLALVYARPLFYFGNIMKPLIWLMNGSARVIIRMFGVNPDAQTDAMSEEEIKIIINNSYNGGEINQTELAYMQNIFSFDERHAKDIMVPRTQMITLNEPFNVDELLETIKEHQFTRYPITDDGDKDHIKGFINVKEFLTEYASGKTIKIANYIHELPMISETTRISDALIRMQREHVHMSLIIDEYGGTAGILTMEDILEEIVGEIRDEFDDDEVNDIVKIDNKTFQVNGRVLLDDLTEEFGIEFDDSEDIDTIGGWLQSRNTNLQKDDYVDTTYDRWVVSEIDNHQIIWVILNYEFNEARPTIGQSDEDEKSE

SEQ ID NO: 273 - protein, 74 aa, Staphylococcus aureus
VMNLAKFSRIKKAGETMATWVAIIFIVAALILGLIGGFLLARKYMMDYLKKNPPINEEMLRMMMMQMGQKPSQK

SEQ ID NO: 274 - protein, 687 aa, Staphylococcus aureus
VFYLSFYFKISYNVFDKIEEGKIHKMFNEKDQLAVDTLRALSIDTIEKANSGHPGLPMGAAPMAYTLWTRHLNFNPQSKDYFNRDRFVLSAGHGSALLYSLLHVSGSLELEELKQFRQWGSKTPGHPEYRHTDGVEVTTGPLGQGFAMSVGLALAEDHLAGKFNKEGYNVVDHYTYVLASDGDLMEGISHEAASFAGHNKLSKLVVLYDSNDISLDGELNKAFSENTKARFEAYGWNYLLVKDGNDLEEIDKAITTAKSQEGPTIIEVKTTIGFGSPNKAGTNGVHGAPLGEVERKLTFENYGLDPEKRFNVSEEVYEIFQNTMLKRANEDESQWNSLLEKYAETYPELAEEFKLAISGKLPKNYKDELPRFELGHNGASRADSGTVIQAISKTVPSFFGGSADLAGSNKSNVNDATDYSSETPEGKNVWFGVREFAMGAAVNGMAAHGGLHPYGATFFVFSDYLKPALRLSSIMGLNATFIFTHDSIAVGEDGPTHEPIEQLAGLRAIPNMNVIRPADGNETRVAWEVALESESTPTSLVLTRQNLPVLDVPEDVVEEGVRKGAYTVYGSEETPEFLLLASGSEVSLAVEAAKDLEKQGKSVRVVSMPNWNAFEQQSEEYKESVIPSSVTKRVAIEMASPLGWHKYVGTAGKVIAIDGFGASAPGDLVVEKYGFTKENILNQVMSL

SEQ ID NO: 275 - protein, 90 aa, Staphylococcus aureus
DLGMDKDEAKKLFAKSESIFKDLKGVKYKVDYKDKKAIEHLDIDYTEVDMKKLNKRLGVSTKENKDISFEKLEKQLKHRGLKEKDKMDDK

SEQ ID NO: 276 - protein, 531 aa, Staphylococcus aureus
LGGGIVMTFLTVMQFIVNIIVVGFMLTVIVIGLIWLIKDKRQSQHSVLRNYPLLARIRYISEKMGPELRQYLFSGDNEGKPFSRNDYKNIVLAGKYNSRMTSFGTTKDYQDGFYIQNTMFPMQRNEISVDNTTLLSTFIYKIANERLFSREEYRVPTKIDPYYLSDDHAIKLGEHLKHPFILKRIVGQSGMSYGALGKNAITALSKGLAKAGTWMNTGEGGLSEYHLKGNGDIIFQIGPGLFGVRDKEGNFSEGLFKEVAQLSNVRAFELKLAQGAKTRGGHMEAEKVNEEIAKIRNVEPYKTINSPNRYEFIHNAEDLIRFVDQLQQLGQKPVGFKIVVSKVSEIETLVRTMVELDKYPSFITIDGGEGGTGATFQELQDGVGLPLFTALPIVSGMLEKYGIRDKVKLAASGKLVTPDKIAIALGLGADFVNIARGMMISVGCIMSQQCHMNTCPVGVATTDAKKEKALIVGEKQYRVTNYVTSLHEGLFNIAAAVGVSSPTEITADHIVYRKVDGELQTIHDYKLKLIS

SEQ ID NO: 277 - protein, 295 aa, Staphylococcus aureus
MGIGRVTQVMGPVIDVRFEHNEVPKINNALVIDVPKEEGTIQLTLEVALQLGDDVVRTIAMDSTDGVQRGMDVKDTGKEISVPVGDETLGRVFNVLGETIDLKEEISDSVRRDPIHRQAPAFDELSTEVQILETGIKVVDLLAPYIKGGKIGLFGGAGVGKTVLIQELINNIAQEHGGISVFAGVGERTREGNDLYFEMSDSGVIKKTAMVFGQMNEPPGARMRVALSGLTMAEYFRDEQGQDVLLFIDNIFRFTQAGSEVSALLGRMPSAVGYQPTLATEMGQLQERITSTTKG

SEQ ID NO: 278 - protein, 18 aa, Staphylococcus aureus
DPIFKQEVENLEKEIRNV

SEQ ID NO: 279 - protein, 272 aa, Staphylococcus aureus
MMEFTIKRDYFITQLNDTLKAISPRTTLPILTGIKIDAKEHEVILTGSDSEISIEITIPKTVDGEDIVNISETGSVVLPGRFFVDIIKKLPGKDVKLSTNEQFQTLITSGHSEFNLSGLDPDQYPLLPQVSRDDAIQLSVKVLKNVIAQTNFAVSTSETRPVLTGVNWLIQENELICTATDSHRLAVRKLQLEDVSENKNVIIPGKALAELNKIMSDNEEDIDIFFASNQVLFKVGNVNFISRLLEGHYPDTTRLFPENYEIKLSIDNGEFY

SEQ ID NO: 280 - protein, 75 aa, Staphylococcus aureus; identical to SEQ ID NO: 263

SEQ ID NO: 281 - protein, 424 aa, Staphylococcus aureus; identical to SEQ ID NO: 264

SEQ ID NO: 282 - protein, 149 aa, Staphylococcus aureus; identical to SEQ ID NO: 265

SEQ ID NO: 283 - protein, 244 aa, Staphylococcus aureus; identical to SEQ ID NO: 266

SEQ ID NO: 284 - protein, 186 aa, Staphylococcus aureus
LKDKIIDNAITLFSEKGYDGTTLDDIAKSVNIKKASLYYHFDSKKSIYEQSVKCCFDYLNNIIMMNQNKSNYSIDALYQFLFEFIFDIEERYIRMYVQLSNTPEEFSGNIYGQIQDLNQSLSKEIAKFYDESKIKMTKEDFQNLILLFLESWYLKASFSQKFGAVEESKSQFKDEVYSLLNIFLKK

SEQ ID NO: 285 - protein, 412 aa, Staphylococcus aureus
LQFFNFLLFYPVFMSIYWIVGSIYFYFTREIRYSLNKKPDINVDELEGITFLLACYNESETIEDTLSNVLALKYEKKEIIIINDGSSDNTAELIYKIKENNDFIFVDLQENRGKANALNQGIKQASYDYVMCLDADTIVDQDAPYYMIENFKHDPKLGAVTGNPRIRNKSSILGKIQTIEYASLIGCIKRSQTLAGAVNTISGVFTLFKKSAVVDVGYWDTDMITEDIAVSWKLHLRGYRIKYEPLAMCWMLVPETLGGLWKQRVRWAQGGHEVLLRDFFSTMKTKRFPLYILMFEQIISILWVYIVLLYLGYLFITANFLDYTFMTYSFSIFLLSSFTMTFINVIQFTVALFIDSRYEKKNMAGLIFVSWYPTVYWIINAAVVLVAFPKALKRKKGGYATWSSPDRGNTQR

SEQ ID NO: 286 - protein, 101 aa, Staphylococcus aureus
MVKPRQREYPTLKSSLNIVRETALIAISCVFWIYCLVVLLVYIGTIFEIHDESINTIRVALNIENTEILDIFETMGIFAIIIFVFFTISILIQKWQRGRES

SEQ ID NO: 287 - protein, 297 aa, Staphylococcus aureus
MAERKRIVKYRKFIILVLSILIILPVSTLDGHHIANADDDSPKKLKYKENSALALNYHRVRKANFLNNFIYFFSSSKEIKNYSVSQSQFESQIKWLKSHDAKFLTLKEFLYYKKKGKFPKRSVWINFDDMDETIYENAYPILKKYKIPATGFIITGHVGEENFHNLDMISKKELKEMYKTGLWEFETHTHDLHNLSKNNKSKLMKASEATIIKDLNKSEKYLTKNFKKSQKTIAYPYGLMNDDKLPVIKKAGLKYGFSLEEKAVTPNSNDYYIPRILISDDAFEHLIKRWDGFHEKD

SEQ ID NO: 288 - protein, 350 aa, Staphylococcus aureus
MKKIRLELVYLRAIICAIIIITHLLTQITLKHENMEGGSLVLQFYIRNIVIFGTPCFIILSQLLTTLNYQKVTYRYLTTRVKYILIPYILMGLFYSYSESLLTDSSFNKQFIENVLLGQWYGYFIVVIMQFFILSYIIFKINYNLFNSKILLLLSFILQQSFLYYFTNNTAFHDTVLHYYPLSENTIIFGWIFYFFLGAYMGYNYERVLNFLERYLVIMIVLAVATYFVFIALANGDYWNVTSFSYSLTPYNSIMFIVILGICTHFKTMLFNTIQMISAFSFFIYLLHPIILDSLFAYTNIFEDNTMVFLAISLLFILGLCIGVGMILREFYIFRFIIGKQPYKLNINAY

SEQ ID NO: 289 - protein, 380 aa, Staphylococcus aureus
DPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 290 - protein, 564 aa, Staphylococcus aureus; identical to SEQ ID NO: 253

SEQ ID NO: 291 - protein, 125 aa, Staphylococcus aureus; identical to SEQ ID NO: 254

SEQ ID NO: 292 - protein, 187 aa, Staphylococcus aureus
MEHTTMKMTAIAKASLALGILATGTITSLHQTVNASEHKAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNF

SEQ ID NO: 293 - protein, 313 aa, Staphylococcus aureus; identical to SEQ ID NO: 123

SEQ ID NO: 294 - protein, 45 aa, Staphylococcus aureus
LFVKVAFLCLKSDETSNVPSVESHQNHFYLTNIMDFLIYLTMIQI

SEQ ID NO: 295 - protein, 361 aa, Staphylococcus aureus
LEHTIMKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 296 - protein, 84 aa, Staphylococcus aureus
DYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 297 - protein, 805 aa, Staphylococcus aureus
VVIVLAMTEQQKFKVLADQIKISNQLDAEILNSGELTRIDVSNKNRTWEFHITLPQFLAHEDYLLFINAIEQEFKDIANVTCRFTVTNGTNQDEHAIKYFGHCIDQTALSPKVKGQLKQKKLIMSGKVLKVMVSNDIERNHFDKACNGSLIKAFRNCGFDIDKIIFETNDNDQEQNLASLEAHIQEEDEQSARLATEKLEKMKAEKAKQQDNNESAVDKCQIGKPIQIENIKPIESIIEEEFKVAIEGVIFDINLKELKSGRHIVEIKVTDYTDSLVLKMFTRKNKDDLEHFKALSVGKWVRAQGRIEEDTFIRDLVMMMSDIEEIKKATKKDKAEEKRVEFHLHTAMSQMDGIPNIGAYVKQAADWGHPAIAVTDHNVVQAFPDAHAAAEKHGIKMIYGMEGMLVDDGVPIAYKPQDVVLKDATYVVFDVETTGLSNQYDKIIELAAVKVHNGEIIDKFERFSNPHERLSETIINLTHITDDMLVDAPEIEEVLTEFKEWVGDAIFVAHNASFDMGFIDTGYERLGFGPSTNGVIDTLELSRTINTEYGKHGLNFLAKKYGVELTQHHRAIYDTEATAYIFIKMVQQMKELGVLNHNEINKKLSNEDAYKRARPSHVTLIVQNQQGLKNLFKIVSASLVKYFYRTPRIPRSLLDEYREGLLVGTACDEGELFTAVMQKDQSQVEKIAKYYDFIEIQPPALYQDLIDRELIRDTETLHEIYQRLIHAGDTAGIPVIATGNAHYLFEHDGIARKILIASQPGNPLNRSTLPEAHFRTTDEMLNEFHFLGEEKAHEIVVKNTNELAD

SEQ ID NO: 298 - protein, 564 aa, Staphylococcus aureus
DPASGYASILGIPTLQTGVFGGIIIGALAAWCYNKFYNINLPSYLGFFAGKRFVPIMMATTSFILAFPMALIWPTIQSGLNAFSTGLLDSNTGVAVFLFGFIKRLLIPFGLHHIFHAPFWFEFGSWKNAAGEIIHGDQRIFIEQIREGAHLTAGKFMQGEFPVMMFGLPAAALAIYHTAKPENKKVVAGLMGSAALTSFLTGITEPLEFSFLFVAPLLFFIHAVLDGLSFLTLYLLDLHLGYTFSGGFIDYFLLGILPNKTQWWLVIPVGLVYAVIYYFVFRFLIVKLKYKTPGREDKQSQAATASATELPYAVLEAMGGKANIKHLDACITRLRVEVNDKSKVDVPGLKDLGASGVLEVGNNMQAIFGPKSDQIKHEMQQIMNGQVVENPTTMEDDKDETVVVAEDKSATSELSHIVHAPLTGEVTPLSEVPDQVFSEKMMGDGIAIKPSQGEVRAPFNGKVQMIFPTKHAIGLVSDSGLELLIHIGLDTVKLNGEGFTLHVEEGQEVKQGDLLINFDLDYIRNHAKSDITPIIVTQGNITNLDFKQGEHGNISFGDQLFEAK

SEQ ID NO: 299 - protein, 99 aa, Staphylococcus aureus
MRGGGNMQQMMKQMQKMQKKMAQEQEKLKEERIVGTAGGGMVAVTVTGHKEVVDVEIKEEAVDPDDIEMLQDLVLAATNEAMNKADELTQERLGKHTQG

SEQ ID NO: 300 - protein, 565 aa, Staphylococcus aureus
LNYQALYRMYRPQSFEDVVGQEHVTKTLRNAISKEKQSHAYIFSGPRGTGKTSIAKVFAKAINCLNSTDGEPCNECHICKGITQGTNSDVIEIDAASNNGVDEIRNIRDKVKYAPSESKYKVYIIDEVHMLTTGAFNALLKTLEEPPAHAIFILATTEPHKIPPTIISRAQRFDFKAISLDQIVERLKFVADAQQIECEDEALAFIAKASEGGMRDALSIMDQAIAFGDGTLTLQDALNVTGSVHDEALDHLFDDIVQGDVQASFKKYHQFITEGKEVNRLINDMIYFVRDTIMNKTSEKDTEYRALMNLELDMLYQMIDLINDTLVSIRFSVNQNVHFEVLLVKLAEQIKGQPQVIANVAEPAQIASSPNTDVLLQRMEQLEQELKTLKAQGVSVAPVQKSSKKPARGIQKSKNAFSMQQIAKVLDKANKADIKLLKDHWQEVIDHAKNNDKKSLVSLLQNSEPVAASEDHVLVKFEEEIHCEIVNKDDEKRSSIESVVCNIVNKNVKVVGVPSDQWQRVRTEYLQNRKNEGDDMPKQQAQQTDIAQKAKDLFGEETVHVIDEE

SEQ ID NO: 301 - protein, 174 aa, Staphylococcus aureus
MQIYLSTLTELDYDKSLNSIEESFDDNPETSWQARAKVKHLRKSPCYNFELEVIAKNENNDVVGHVLLIEVEINSDDKTYYGLAIASLSVHPELRGQKLGRGLVQAVEERAKAQEYSTVVVDHCFDYFEKLGYQNAAEHDIKLESGDAPLLVKYLWDNLTDAPHGIVKFPEHFY

SEQ ID NO: 302 - protein, 33 aa, Staphylococcus aureus
LKTIQRIIRGTCLWEVAFLYVKFDSSELDVQFE

SEQ ID NO: 303 - protein, 88 aa, Staphylococcus aureus
IGNDVASDSIYDYLEKVLNLNISYSSKSITFEPFDEQAYQLFGDVSVAYSATVRSIVYLENTMPFQYNISKHLANEFKFNDFSRRRIK

SEQ ID NO: 304 - protein, 129 aa, Staphylococcus aureus
DREKLQERLAKLAGGVAVIKVGAASETELKERKLRIEDALNSTRAAVEEGIVAGGGTALVNVYQKVSEIEAEGDIETGVNIVLKALTAPVRQIAENAGLEGSVIVERLKNAEPGVGFNAATNEWVNMLE

SEQ ID NO: 305 - protein, 232 aa, Staphylococcus aureus
MNREMLYLNRSDIEQAGGNHSQVYVDALTEALTAHAHNDFVQPLKPYLRQDPENGHIADRIIAMPSHIGGEHAISGIKWIGSKHDNPSKRNMERASGVIILNDPETNYPIAVMEASLISSMRTAAVSVIAAKHLAKKGFKDLTIIGCGLIGDKQLQSMLEQFDHIERVFVYDQFSEACARFVDRWQQQRPEINFIATENAKEAVSNGEVVITCTVTDQPYIEYDWLQKGAFI

SEQ ID NO: 306 - protein, 326 aa, Staphylococcus aureus
LIEKSQACHDSLLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEVHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 307 - protein, 488 aa, Staphylococcus aureus
DPVIGRDKEITRVIEVLSRRTKNNPVLIGEPGVGKTAIAEGLAQAIVNNEVPETLKDKRVMSLDMGTVVAGTKYRGEFEERLKKVMEEIQQAGNVILFIDELHTLVGAGGAEGAIDASNILKPALARGELQCIGATTLDEYRKNIEKDAALERRFQPVQVDEPSVVDTVAILKGLRDRYEAHHRINISDEAIEAAVKLSNRYVSDRFLPDKAIDLIDEASSKVRLKSHTTPNNLKEIEQEIEKVKNEKDAAVHAQEFENAANLRDKQTKLEKQYEEAKNEWKNAQNGMSTSLSEEDIAEVIAGWTGIPLTKINETESEKLLSLEDTLHERVIGQKDAVNSISKAVRRARAGLKDPKRPIGSFIFLGPTGVGKTELARALAESMFGDDDAMIRVDMSEFMEKHAVSRLVGAPPGYVGHDDGGQLTEKVRRKPYSVILFDEIEKAHPDVFNILLQVLDDGHLTDTKGRTVDFRNTIIIMTSNVGAQELQD

SEQ ID NO: 308 - protein, 664 aa, Staphylococcus aureus
MIGKIINERYKIVDKLGGGGMSTVYLAEDTILNIKVAIKAIFIPPREKEETLKRFEREVHNSSQLSHQNIVSMIDVDEEDDCYYLVMEYIEGPTLSEYIESHGPLSVDTAINFTNQILDGIKHAHDMRIVHRDIKPQNILIDSNKTLKIFDFGIAKALSETSLTQTNHVLGTVQYFSPEQAKGEATDECTDIYSIGIVLYEMLVGEPPFNGETAVSIAIKHIQDSVPNVTTDVRKDIPQSLSNVILRATEKDKANRYKTIQEMKDDLSSVLHENRANEDVYELDKMKTIAVPLKKEDLAKHISEHKSNQPKRETTQVPIVNGPAHHQQFQKPEGTVYEPKPKKKSTRKIVLLSLIFSLLMIALVSFVAMAMFGNKYEETPDVIGKSVKEAEQIFNKNNLKLGKISRSYSDKYPENEIIKTTPNTGERVERGDSVDVVISKGPEKVKMPNVIGLPKEEALQKLKSLGLKDVTIEKVYNNQAPKGYIANQSVTANTEIAIHDSNIKLYESLGIKQVYVEDFEHKSFSKAKKALEEKGFKVESKEEYSDDIDEGDVISQSPKGKSVDEGSTISFVVSKGKKSDSSDVKTTTESVDVPYTGKNDKSQKVKVYIKDKDNDGSTEKGSFDITSDQRIDIPLRIEKGKTASYIVKVDGKTVAEKEVSYDDV

SEQ ID NO: 309 - protein, 28 aa, Staphylococcus aureus
DQLMQLALDNHSKDNVTFILAAIEGDKV

SEQ ID NO: 310 - protein, 517 aa, Staphylococcus aureus
MAANFKEQSKKHFDLNGQSYTYYDLKAVEEQGITKVSNLPYSIRVLLESLLRQEDDFVITDDHIKALSQFGKDGNEGEVPFKPSRVILQDFTGVPAVVDLASLRKAMDDVGGDITKINPEVPVDLVIDHSVQVDSYANPEALERNMKLEFERNYERYQFLNWATKAFDNYNAVPPATGIVHQVNLEYLASVVHVRDVDGEKTAFPDTLVGTDSHTTMINGIGVLGWGVGGIEAEAGMLGQPSYFPIPEVIGVRLVNSLPQGATATDLALRVTQELRKKGVVGKFVEFFGPGVQHLPLADRATIANMAPEYGATCGFFPVDDESLKYMKLTGRSDEHIALVKEYLKQNHMFFDVEKEDPNYTDVIELDLSTVEASLSGPKRPQDLIFLSDMKSSFENSVTAPAGNQGHGLDKSEFDKKAEINFKDGSKATMKTGDIAIAAITSCTNTSNPYVMLGAGLVAKKAVEKGLKVPEYVKTSLAPGSKVVTGYLRDAGLQPYLDDLGFNLVGYGCTTCIGNSG

SEQ ID NO: 311 - protein, 251 aa, Staphylococcus aureus
VIKFKNVTKRYGKHVAVDNISFNINEGEFFVLIGPSGCGKTTTLKMINRLIHLSEGYIYFKDKPISDYPVYEMRWDIGYVLQQIALFPHMTIKENIAQVPQMKKWKEKDIDKRVDELLEMVGLEPEKYKNRKPDELSGGQRQRVGVIRALAADPPVILMDEPFSALDPISREKLQDDLIELQTKIKKTIIFVTHDIQEAMKLGDKICLLNEGHIEQIDTPEGFKNNPQSEFVKQFMGSHLEDDAPCVEENA

SEQ ID NO: 312 - protein, 144 aa, Staphylococcus aureus
HGLMKGYTTSELSHLIDELRFKGFLNENDEILMCDTSIKKLLSNEVEVFTTPFKQKATEKVFINTVEGVDRVLFSQLVEVRKKLSDKLTIAPVSIFSDYTLEEFAKRKPASKQDMINIDGVGSYKLKHYCPAFLETIQNYKAKV

SEQ ID NO: 313 - protein, 42 aa, Staphylococcus aureus
DRAIRSVAFFLTALPSYWIASILIIYVSVKLNILPTSGLTGP

SEQ ID NO: 314 - protein, 345 aa, Staphylococcus aureus
IIAIIILIFISFFFSGSETALTAANKAKFKTEADKGDKKAKGIVKLLEKPSEFITTILIGNNVANILLPTLVTIMALRWGISVGIASAVLTVVIILISEVIPKSVAATFPDKITRLVYPIINICVIVFRPITLLLNKLTDSINRSLSKGQPQEHQFSKEEFKTMLAIAGHEGALNEIETSRLEGVINFENLKVKDVDTTPRINVTAFASNATYEEVYETVMNKPYTRYPVYEGDIDNIIGVFHSKYLLAWSNKKENQITNYSAKPLFVNEHNKAEWVLRKMTISRKHLAIVLDEFGGTEAIVSHEDLIEELLGMEIEDEMDKKEKEKLSQQQIQFQQRKNRNVSI

SEQ ID NO: 315 - protein, 19 aa, Staphylococcus aureus
MINVTLKQIQSWIPCEIED

SEQ ID NO: 316 - protein, 393 aa, Staphylococcus aureus
VILLRFKDANKSINNRTKSILIYIKVANPDISLEENEMTKENICIVFGGKSAEHEVSILTAQNVLNAIDKDKYHVDIIYITNDGDWRKQNNITAEIKSTDELHLENGEALEISQLLKESSSGQPYDAVFPLLHGPNGEDGTIQGLFEVLDVPYVGNGVLSAASSMDKLVMKQLFEHRGLPQLPYISFLRSEYEKYEHNILKLVNDKLNYPVFVKPANLGSSVGISKCNNEAELKEGIKEAFQFDRKLVIEQGVNAREIEVAVLGNDYPEATWPGEVVKDVAFYDYKSKYKDGKVQLQIPADLDEDVQLTLRNMALEAFKATDCSGLVRADFFVTEDNQIYINETNAMPGFTAFSMYPKLWENMGLSYPELITKLIELAKERHQDKQKNKYKID

SEQ ID NO: 317 - protein, 400 aa, Staphylococcus aureus
MNYSSRQQPDKHWLRKVDWVLVATIAVLAIFSVLLINSAMGGGQYSANFGIRQIFYYILGAIFAGIIMFISPKKIKHYTYLLYFLICLLLIGLLVIPESPITPIINGAKSWYTFGPISIQPSEFMKIILILALARVVSRHNQFTFNKSFQSDLLLFFKIIGVSLVPSILILLQNDLGTTLVLAAIIAGVMLVSGITWRILAPIFITGIVGAMTVILGILYAPALIENLLGVQLYQMGRINSWLDPYTYSSGDGYHLTESLKAIGSGQLLGKGYNHGEVYIPENHTDFIFSVIGEELGFIGSVILILIFLFLIFHLIRLAAKIEDQFNKIFIVGFVTLLVFHILQNIGMTIQLLPITGIPLPFISYGGSALWSMMTGIGIVLSIYYHEPKRYVDLYHPKSN

SEQ ID NO: 318 - protein, 205 aa, Staphylococcus aureus
DHGIVFNASLPLYKDAIHQKGSMRSNDNGDDMSMMVGTVLSGFEYRAQKEKYDNLYKFFKENEKKYQYTGFTKEAINKTQNVGYKNEYFYITYSSRSLKEYRKYYEPLIRKNDKEFKEGMERARKEVNYAANTDAVATLFSTKKNFTKDNTVDDVIELSDKLYNLKNKPDKSTITIQIGKPTINTKKAFYDDNRPIEYGVHSKDE

SEQ ID NO: 319 - protein, 470 aa, Staphylococcus aureus
MGCTVKMNKINDRDLTELSSYWVYQNIDIKKEFKVNGKRFKQVDSYNDDKNSNLNGAADIKIYELLDDKSKPTGQQTIIYQGTSNEAINPNNPLKSSGFGDDWLQNAKLMNNDNESTDYLKQTDQLSNQYKIKLEDADRLSNSDFLKKYRMESSNFKNKTIVADGGNSEGGAGAKYQGAKHPNEKVVATDSAMIPYAAWQKFARPRFDNMISFNSTNDLLTWLQDPFIKDMPGKRVNINDGVPRLDTLIDSHVGYKRKLNRKDNTYDTVPLIKIKSVKDTEIKNGKKVKKTINITLDMDGRIPINVWTGDSIARSGRGTLIKLNLENLDALSKLITGETSGMLAECVIFLNESFNISENENKNFADRKKQLSEGFKDKINLFQLEEMERTLISKINSLEEVADETIESISAVKHLLPDFALDALKERINELFKGIKSFIEKVYDSIDNEILEIFKNIDHDFRDGVSEEMM

SEQ ID NO: 320 - protein, 510 aa, Staphylococcus aureus
DHYVIQYFSGLIGGRGRRANLYGLFNKAIEFENSSFRGLYQFIRFIDELIERGKDFGEENVVGPNDNVVRMMTIHSSKGLEFPFVIYSGLSKDFNKRDLKQPVILNQQFGLGMDYFDVDKEMAFPSLASVAYRAVAEKELVSEEMRLVYVALTRAKEQLYLIGRVKNDKSLLELEQLSISGEHIAVNERLTSPNPFHLIYSILSKHQSASIPDDLKFEKDIAQIEDSSRPNVNISIVYFEDVSTETILDNDEYRSVNQLETMQNGNEDVKAQIKHQLDYRYPYVNDTKKPSKQSVSELKRQYETEESGTSYERVRQYRIGFSTYERPKFLSEQGKRKANEIGTLMHTVMQHLPFKKERISEVELHQYIDGLIDKHIIEADAKKDIRMDEIMTFINSELYSIIAEAEQVYRELPFVVNQALVDQLPQGDEDVSIIQGMIDLIFVKDGVHYFVDYKTDAFNRRRGMTDEEIGTQLKNKYKIQMKYYQNTLQTILNKEVKGYLYFFKFGTLQL

SEQ ID NO: 321 - protein, 124 aa, Staphylococcus aureus
MKFLSFKYNDKTSYGVKVKREDAVWDLTQVFADFAEGDFHPKTLLAGLQQNHTLDFQEQVRKAVVAAEDSGKAEDYKISFNDIEFLPPVTPPNNVIAFGRNYKDHANELNHEVEKLYVFTKAAS

SEQ ID NO: 322 - protein, 180 aa, Staphylococcus aureus; identical to SEQ ID NO: 194

SEQ ID NO: 323 - protein, 239 aa, Staphylococcus aureus; identical to SEQ ID NO: 192

SEQ ID NO: 324 - protein, 496 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTFNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHID

SEQ ID NO: 325 - protein, 496 aa, Staphylococcus aureus; identical to SEQ ID NO: 324

SEQ ID NO: 326 - protein, 284 aa, Staphylococcus aureus
RYLHQHPELSFHEDETAKYIAEFYKGKDVEVETNVGPRGIKVTIDSGKPGKTLAIRADFDALPITEDTGLSFASQNKGVMHACGHDAHTAYMLVLAETLAEMKDSFTGKVVVIHQPAEEVPPGGAKTMIENGVLDGVDHVLGVHVMSTMKTGKVYYRPGYVQTGRAFFKLKVQGKGGHGSSPHMANDAIVAGSYFVTALQTVVSRRLSPFETGVVTIGSFDGKGQFNVIKDVVEIEGDVRGLTDATKATIEKEIKRLSKGLEDMYGVTCTLEYNDDYPALYNDP

SEQ ID NO: 327 - protein, 188 aa, Staphylococcus aureus
GSTMACVSEAIHLLPYNVFFVPARGGLGENVVFQANTIAASMAQQAGGYYTTMYVPDNVSETTYNTLLLEPSVINTLDKIKQANVILHGIGDALKMAHRRQSPEKVIEQLQHHQAVGEAFGYYFDTQGQIVHKVKTIGLQLEDLESKDFIFAVAGGKSKGEAIKAYLTIAPKNTVLITDEAAAKIILE

SEQ ID NO: 328 - protein, 182 aa, Staphylococcus aureus
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYTG

SEQ ID NO: 329 - protein, 48 aa, Staphylococcus aureus
DNFKKQPHHLIYEELLQQGITLGITTRGDGLSDYPKNAFNMARYIDDR

SEQ ID NO: 330 - protein, 329 aa, Staphylococcus aureus
VILALPMFILLTFYLQPLVRYIFERIVMAVIVIIGVIVSVFTILYFSPLDAAYSILGQNATKAQIHQFNVLHHLNEPYFIQLWDTIKGVFTFDLGTTYKGNEVVTKAVGERIPITIIVAVLALMVALIIAIPIGIISAMKRNSWLDITLMIIALIGLSIPSFWQGLLFILAFSLKLDILPPSYMPEHPISLILPVLVIGTSIAASITRMTRSSVLEVMRSDYVLTAYAKGLSTTQVVIKHILKNAIIPIVTLVGLLVAELLGGSAVTEQVFNINGIGRYIVQKQLIPDIPAVMGGVVYISIVISLANLIIDIFYALIDPKLRSEINERK

SEQ ID NO: 331 - protein, 390 aa, Staphylococcus aureus
VRHMAQLNSKIASLKLFASYAIATYILVILTSALNLFKGYVADTFYIAETLLIVLTIILIIILTTEQTWKHHDLWRRIVEVLLLLMTLTGNVFTLLMFVSIRRYQRTSQIHSYNGWESFIRKTTRHRIAIIGLLILVYMLTLSIVSQFTFDTTLATKNQFNALLHGPSLAYPFGTDDFGRDLFTRVVVGTKLTFSISIISVVIAVIFGVLLGTIAGYFNHIDNLIMRILDVVFAIPSLLLAVAIIASFGASIPNLIIALSIGNIPSFARTMRASVLEIKRMEYVDAARITGENTWNIIWRYILPNAIAPMIVRFSLNIGVVVLTTSSLSFLGLGVAPDVAEWGNILRTGSNYLETHSNLAIVPGVCIMFVVLAFNFIGDAVRDALDPRIH

SEQ ID NO: 332 - protein, 591 aa, Staphylococcus aureus
VKKIISIAIIVLALVLSGCGVPTKSEVAQKSSKVEVKGERPTIHFLGQASYENDMNIVKDQLENAGFNVKMNIQPDYGSYRTQRQAGNYDIQIDDWMTVFGDPNYAMTALFSSTGSNSLLKDKHVDQLLNKASTQNEADVKQTYKQIEDEVVFDKGYMAPLYGSKKNLVYDNKVLDKNSVGLPNSRALIWQQFDYNNSRERDTRPLVMTQQDGEIPTLDPIRSIAPSVYSINMNMYTRLLLLDENDHLTTKGSLSHDYAVNKDNKAFYFLLRDDDYFAKVVNGQARNTGERVSAEDVKFSLDRARDKKSVPNNNTYNMHKHINDIKILKDEDIDQLRKEKDKDDKSIYDKLIKAYNVKSLTTDGQKVNNKDGIYQIVKITTDQSMPREVNYLTHSSAGILSKKFVNQVNQEYPKGYGDSSTIPANSDGKNALYASGAYIMTQKNAYQATFQRNPGFNETEKGSYGPAKIKNITLKFNGDPNNALSELRNHSIDMLADVNQKHFDLIKSDKNLSIIRKNGRKSVFLMLNIKKGIFKTHPNLRQAVVNAIDQDQFIKFYRGDKFKIASPITPLVDTGNEQRQDLEKVEKAINQ

SEQ ID NO: 333 - protein, 234 aa, Staphylococcus aureus
MVINLNDKQTKTSKEGLISVSHPLAAKIGKDVLDQGGNAMDAVIAIQLALNVVEPFASGIGGGGYLLYYEQSTGSITAFDARETAPEHVDKQFYLDDSGEYKSFFDMTTHGKTVAVPAIPKLFDYIHKRYAKLSLEDLINPAIELAIEGHAANWATEKYSRQQHARLTKYHETAQVFTHENQYWREGDWIVQPELGKTFQILREQGFNAFYKGDIAKQLVNVVKACGGTITLED

SEQ ID NO: 334 - protein, 49 aa, Staphylococcus aureus
VISANLISIGSQVSTKDQLLLPRMRYGNAYNMSAKAIHIHNDNQLNTAI

SEQ ID NO: 335 - protein, 73 aa, Staphylococcus aureus
RIAVLSWLSLCICIALALILYALPYLILGSNNWSFVLTWLPIEIKLALITTLIALFSTLIVILLFLHTKITKT

SEQ ID NO: 336 - protein, 286 aa, Staphylococcus aureus
VFIMSKIFVTGATGLIGIKLVQRLKEEGHEVAGFTTSENGQQKLAAVNVKAYIGDILKADTIDQALADFKPEIIINQITDLKNVDMAANTKVRIEGSKNLIDAAKKHDVKKVIAQSIAFMYEPGEGLANEETSLDFNSTGDRKVTVDGVVGLEEETARMDEYVVLRFGWLYGPGTWYGKDGMIYNQFMDGQVTLSDGVTSFVHLDDAVETSIQAIHFENGIYNVADDAPVKGSEFAEWYKEQLGVEPNIDIQPAQPFERGVSNEKFKAQGGTLIYQTWKDGMNPIK

SEQ ID NO: 337 - protein, 41 aa, Staphylococcus aureus
MTNLNYDEDQSRKTAPRSFQFESTLLLFFIYYISILVADFL

SEQ ID NO: 338 - protein, 181 aa, Staphylococcus aureus
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYT

SEQ ID NO: 339 - protein, 188 aa, Staphylococcus aureus; identical to SEQ ID NO: 327

SEQ ID NO: 340 - protein, 328 aa, Staphylococcus aureus
AIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYS

SEQ ID NO: 341 - protein, 33 aa, Staphylococcus aureus
MAKKPTALIILDGFANRESEHGNAVKLANKPNF

SEQ ID NO: 342 - protein, 95 aa, Staphylococcus aureus
DQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 343 - protein, 147 aa, Staphylococcus aureus
ILNFIFSFLASMFFCVIFDAPRKLYLSCGFVGTCGWMVYTLFFNGFNVHTIYSSFFGSLALGLLSHYMARKQKEPAIIFMVTGIIPLVPGGLAYDATKNLVLLNFSTAINTMLEVTLIAGAIALGLLFADQISKLIVSGFVKSFKRL

SEQ ID NO: 344 - protein, 506 aa, Staphylococcus aureus
LGIEYLRGEFLFMEKKNKQIDRGDLKQNLSEKFVWAIAYGSCIGWGAFILPGDWIKQSGPIAASIGIVIGALLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 345 - protein, 65 aa, Staphylococcus aureus
DPTLRRVMNEIDKKPELRERFITSDDAWDMMTSKTTVVIVDTHKPELVLDENVLNKANRKVVIDH

SEQ ID NO: 346 - protein, 180 aa, Staphylococcus aureus
IGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKNPDLHKNATYKLLGGKYMGYLIFVFFIFVFGLLFINVDTRRAIYFIPIWFILLAFMYLRYKRIAAKSNK

SEQ ID NO: 347 - protein, 275 aa, Staphylococcus aureus
MRMKEDHMKNGQLKPGYNLQIATNSQFVLSYDLFQNPTDTRTLIPFLTMIQNTFGYLPEYIVADAGYGSEQNYMAIIDDFNKTPLITYGMFIKDKTRKFKSGIFNTQNWKYDELNNEFICPNNKRIGFKRYAYRNDRYGFKRDFKLYECDDCSSCSLRHQCMKPNSKSNKKIMKNYNWEYFKVQINQKLSEPETKNIYSQRKIDVEPAFGFMKAILGFTRMSVRGINKVKRELGFVLMALNIRKIAAQRAVHYKIHIKKADFYQIINRNQLFYIA

SEQ ID NO: 348 - protein, 275 aa, Staphylococcus aureus
MYKIYNMTQLTLPIETSVRIPQNDISRYVNEIVETIPDSEFDEFRHHRGATSYHPKMMLKIILYAYTQSVFSGRRIEKLLHDSIRMMWLAQDQTPSYKTINRFRVNPNTDALIESLFIQFHSQCLKQNLIDNNSIFIDGTKVEANANRYTFVWKKSIQNHESKLNENSKTLYRDLVEEKIIPEIKEDGDSDLTIEEIDLIGSHLDKEIEDLNHSIENEDCAQIRKQTRKKITEIKKFKKKFDDYSERKNKYEEQKSILKDRNSFSKTDLIMMQLL

SEQ ID NO: 349 - protein, 100 aa, Staphylococcus aureus
SVVGTTLVAETVKDLEGKDLSDKVIVTNSIDETFVPYVEKALGLITEENGITSPSAIVGLEKGIPTVVGVEKAVKNISNNMLVTIDAAQGKIFEGYANVL

SEQ ID NO: 350 - protein, 78 aa, Staphylococcus aureus
MAYISLNYHSPTIGMHQNLTVILPEDQSFFNSDTTVKPLKTLMLLHGLSSDETTYMRYTSIERYANEHKLAVIMPNVD

SEQ ID NO: 351 - protein, 743 aa, Staphylococcus aureus
DQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 352 - protein, 110 aa, Staphylococcus aureus
VEDLERVLITGGAGFIGSHLVDDLQQDYDVYVLDNYRTGKRENIKSLADDHVFELDIREYDAVEQIMKTYQFDYVIHLAALVSVAESVEKPILSQEINVVATLRLLEIIK

SEQ ID NO: 353 - protein, 40 aa, Staphylococcus aureus; identical to SEQ ID NO: 149

SEQ ID NO: 354 - protein, 260 aa, Staphylococcus aureus
IFMTNNKVALVTGGAQGIGFKIAERLVEDGFKVAVVDFNEEGAKAAALKLSSDGTKAIAIKADVSNRDDVFNAVRQTAAQFGDFHVMVNNAGLGPTTPIDTITEEQFKTVYGVNVAGVLWGIQAAHEQFKKFNHGGKIINATSQAGVEGNPGLSLYCSTKFAVRGLTQVAAQDLASEGITVNAFAPGIVQTPMMESIAVATAEEAGKPEAWGWEQFTSQIALGRVSQPEDVSNVVSFLAGKDSDYITGQTIIVDGGMRFR

SEQ ID NO: 355 - protein, 794 aa, Staphylococcus aureus
VKKMDYKETLLMPKTDFPMRGGLPNKEPQIQEKWDAEDQYHKALEKNKGNETFILHDGPPYANGNLHMGHALNKILKDFIVRYKTMQGFYAPYVPGWDTHGLPIEQALTKKGVDRKKMSTAEFREKCKEFALEQIELQKKDFRRLGVRGDFNDPYITLKPEYEAAQIRIFGEMADKGLIYKGKKPVYWSPSSESSLAEAEIEYHDKRSASIYVAFDVKDDKGVVDADAKFIIWTTTPWTIPSNVAITVHPELKYGQYNVNGEKYIIAEALSDAVAEALDWDKASIKLEKEYTGKELEYVVAQHPFLDRESLVINGDHVTTDAGTGCVHTAPGHGEDDYIVGQKYELPVISPIDDKGVFTEEGGQFEGMFYDKANKAVTDLLTEKGALLKLDFITHSYPHDWRTKKPVIFRATPQWFASISKVRQDILDAIENTNFKVNWGKTRIYNMVRDRGEWVISRQRVWGVPLPVFYAENGEIIMTKETVNHVADLFAEHGSNIWFEREAKDLLPEGFTHPGSPNGTFTKETDIMDVWFDSGSSHRGVLETRPELSFPADMYLEGSDQYRGWFNSSITTSVATRGVSPYKFLLSHGFVMDGEGKKMSKSLGNVIVPDQVVKQKGADIARLWVSSTDYLADVRISDEILKQTSDVYRKIRNTLRFMLGNINDFNPDTDSIPESELLEVDRYLLNRLREFTASTINNYENFDYLNIYQEVQNFINVELSNFYLDYGKDILYIEQRDSHIRRSMQTVLYQILVDMTKLLAPILVHTAEEVWSHTPHVKEESVHLADMPKVVEVD

SEQ ID NO: 356 - protein, 383 aa, Staphylococcus aureus
DQVQGSLEIIYSLQEELKEITGMDEVTLQPAAGAHGEWTALMIFKAYHENNGEGHRDEVIVPDSAHGTNPASASFAGFKSVTVKSNERGEVDIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSKHFEIPYKQYCKHEFVLSGVRQKEFGVRTLDMAKRLLDFGVHPPTIYFPLNVEEGMMIEPTETESKETLDYFIDTLISIAEEAKNDPDKVLEAPHTTVIDRLDEATAARKPILKFENLKQEK

SEQ ID NO: 357 - protein, 56 aa, Staphylococcus aureus
LIKSGKARAHTNIALIKYWGKKDEALIIPMNNSISVTLEKFYTETKVTFNDQLTQD

SEQ ID NO: 358 - protein, 306 aa, Staphylococcus aureus
MTRKGYGESTGKIILIGEHAVTFGEPAIAVPFNAGKIKVLIEALESGNYSSIKSDVYDGMLYDAPDHLKSLVNRFVELNNITEPLAVTIQTNLPPSRGLGSSAAVAVAFVRASYDFLGKSLTKEELIEKANWAEQIAHGKPSGIDTQTIVSGKPVWFQKGHAETLKTLSLDGYMVVIDTGVKGSTRQAVEDVHKLCEDPQYMSHVKHIGKLVLRASDVIEHHNFEALADIFNECHADLKALTVSHDKIEQLMKIGKENGAIAGKLTGAGRGGSMLLLAKDLPTAKNIVKAVEKAGAAHTWIENLGG

SEQ ID NO: 359 - protein, 197 aa, Staphylococcus aureus
NAIVRNSGGLGVVLDQGVLNISLMFKGQTETTIDEAFTVMYLLISKMFENENVDIDTMEIEHSYCPGKFDLSIDGKKFAGISQRRVRGGIAVQIYLCVEGSGSERALMMQTFYEHALKGEVTKFKYPEIEPSCMASLETLLNKTITVQDVMFLLLYAIKDLGGVLNMTPITQEEWQRYDTYFDKMIERNKKMIDQMQ

SEQ ID NO: 360 - protein, 255 aa, Staphylococcus aureus
VTMKRLSIIVIIGIFIITGCDWQRTSKERSKNAQNQQVIKIGYLPITHSANLMMTKKLLSQYNHPKYKLELVKFNNWPDLMDALNSGRIDGASTLIELAMKSKQKGSNIKAVALGHHEGNVIMGQKGMHLNEFNNNGDDYHFGIPHRYSTHYLLLEELRKQLKIKPGHFSYHEMSPAEMPAALSEHRITGYSVAEPFGALGEKLGKGKTLKHGDDVIPDAYCCVLVLRGELLDQHKDVAQAFVQDYKKSGFKMND

SEQ ID NO: 361 - protein, 246 aa, Staphylococcus aureus
MIKIQQLQHHFGSHKVIHNFNLDISKGEIVTFIGKSGCGKSTLLNIIGGFIHPSSGRVIIDNEIKQQPSPDCLMLFQHHNLLPWKTINDNIRIGLQQKISDEEINAQLKLVDLEDRGKHFPEQLSGGMKQRVALCRAHVHKPNVILMDEPLGALDAFTRYKLQDQLVQLKHKTQSTIILVTHDIDEAIYLSDRIVLLGEGCNIISQYEITASHPRSRNDSHLLKIRNEIMETFALNHHQVEPEYYL

SEQ ID NO: 362 - protein, 328 aa, Staphylococcus aureus
VKMMPRKFRVLQIGGDDLEPIFQHKKGVSWDYFDIGLFEFDSGYVEAIEAIVEAEGRFDFIYIQAPYSETLTNLLQMISEPYNTYVDESFWSVEYEQDENVQKYVVQPLHYRNIEERNNKLEAVSFSGQYGDKVSPKLALVHPNFKGDVVYQGNSELTLSGEFGKEFKPIASWQNNLVYDKDKVIQIWPEFDIDGAVELQYTFRLIQTGADGALIEQIVLTDDMLDSPLEIPAKPFDAYISVTVKARGNGTVHLGPIHKRWSRLDMGQFLLGGSRFVDSQRQEFIYYFHPGDMKPPLNVYFSGYRTAEGFEGYYMMKRMNAPFLLIGD

SEQ ID NO: 363 - protein, 121 aa, Staphylococcus aureus
DQDDIIAVKTIHAEHDVVEALRTLRLVIDMSKEPDLYLQISAISAGIPQINGQQTDYVSDYDNGRIINTVDELDDALNYYLFYLKNWNYAYAYSLKLIDAYASKNIINQLDELIEGENDAT

SEQ ID NO: 364 - protein, 77 aa, Staphylococcus aureus; identical to SEQ ID NO: 262

SEQ ID NO: 365 - protein, 129 aa, Staphylococcus aureus; identical to SEQ ID NO: 304

SEQ ID NO: 366 - protein, 354 aa, Staphylococcus aureus; identical to SEQ ID NO: 179

SEQ ID NO: 367 - protein, 339 aa, Staphylococcus aureus
VKIMTEIQKPYDLKGRSLLKESDFTKAEFEGLIDFAITLKEYKKNGIKHHYLSGKNIALLFEKNSTRTRAAFTVASIDLGAHPEFLGKNDIQLGKKESVEDTAKVLGRMFDGIEFRGFSQQAVEDLAKFSGVPVWNGLTDDWHPTQMLADFMTIKENFGYLEGINLTYVGDGRNNIAHSLMVAGAMLGVNVRICTPKSLNPKEAYVDIAKEKASQYGGSVMITDNIAEAVENTDAIYTDVWVSMGEESEFEQRINLLKDYQVNQQMFDLTGKDSTIFLHCLPAFHDTNTLYGQEIYEKYGLAEMEVTDQIFRSEHSKVFDQAENRMHTIKAVMAATLGS

SEQ ID NO: 368 - protein, 205 aa, Staphylococcus aureus
DRDCPFNIEGGDELVLSKDVLAIGVSERTSAQAIEKLARRIFENPQATFKKVVAIEIPTSRTFMHLDTVFTMIDYDKFTMHSAILKAEGNMNIFIIEYDDVNKDIAIKQSSHLKDTLEDVLGIDDIQFIPTGNGDVIDGAREQWNDGSNTLCIRPGVVVTYDRNYVSNDLLRQKGIKVIEISGSELVRGRGGPRCMSQPLFREDI

SEQ ID NO: 369 - protein, 243 aa, Staphylococcus aureus
MTEWTREERYQRIEDVDTEYFKTLKQQVDQSKFRQQFHIQPETGLLNDPNGLIFYKGKYYVSHQWFPLGAVHGLKYWYNYTSDDLINFKAEGPILNPDTKYDSHGVYSGSAFEYNGHLYYMYTGNHRDNHWQRHASQMIARLKEDGSVEKFPKPVISQQPEGYTSHFRDPKVFKYDEKYYAIIGAQNNDQQGRLLLYNTEDIINWHYLGEINTELDDFGYMWECPDYFNVDNQDVILICPQGI

SEQ ID NO: 370 - protein, 316 aa, Staphylococcus aureus
MKNISDIAKLAGVSKSTVSRFLNNGSVSKKTSEKLTRIIAEHDYQPNQFAQSLRARQTHLIGAIIPRMNSYAVDETIKGLAKQCQKYESQLILNYTGLNIEAEIQALETLARSKVDGIVLMATDITERHIEVINKMNVPIVIVGQQHEQLHSIVHDDYKAGQIIGEWIGQQGYQQVEVFSVSEKDIAVGIHRKRGLLDQLAKYQIKPNIHETNFTYVEAQKDVANVLENVEQVDAVVGATDTIALAAYKYYSDKKDVMKPHQIYGFGGDPMTQLVSPSIKTIHYNYFEAGQCAMEEIQQMLKKQDMPYSVTVDVNI

SEQ ID NO: 371 - protein, 428 aa, Staphylococcus aureus
LSDYYEKKGVVSMNLNDTIFMFLCTLLVWLMTPGLSLFYGGLVQSKNALNTVMQSMAAIVLVTFVWITVGFTISFGNGNLWFGNWEYTFLNHVGFATQEDISPHIPFALFMLFQMMFCTIAISILSGSIAEKMKFIPYLLFVVIWTALVYSPVAHWVWGGGWINKLGVLDFAGGTVVHITSGVSGLVLAIMIGKGNKHSESTPHNLIITLIGGIFVWIGWYGFNVGSAFTFDNIAMLAFTNTVISASAGAIGWLILEYIFKKTTSLLGLLLGALAGLVVITPAAGYVTYLSATIMALIGGICCYIVINYIKVKLKYHDALDAFGIHGVGGIIGAVLTAVFQSKKANPDIENGFIYTGDIHIILVQILCVTAVVIFSIVMTFIIAKVIKLITPLSVTEQETNIGLDKIVHGEHAYFEGELNRFNKHIRY

SEQ ID NO: 372 - protein, 82 aa, Staphylococcus aureus
VIGKGEIIMIHELGTVGMVCPFPLIEAQKKMATLQSGDELKIDFDCTQATEAIPNWAAENGYPVTNYEQIDNASWTITIQKV

SEQ ID NO: 373 - protein, 253 aa, Staphylococcus aureus
VAIMIAKVIVDVASKSVDYKFDYIIPEQLESVIQPGVRVIVPFGPRTIQGYVMEVTAEPDAQLDVSKLKKIIEVKDIQPELTSELIALSEWMGSTHVIKRISMLEVMLPSAIKAKYKKAFKMKDDIELPSALLQKFDKHGYYYYKDAQKNNDIQLLMKLLKDDIVEEKTILTQNITKKTKRAVRVIEGYHPDEVLAKLEKVIKQYDLYAYLSEEQHKTIFLTDIEDMGFSKSSLDGLIKKGYVEKYDAVVERD

SEQ ID NO: 374 - protein, 619 aa, Staphylococcus aureus
MPKNKILIYLLSTTLVLPTLVSPTAYADTPQKDTTAKTTSHDSKKSNDDETSKDTTSKDIDKADKNNTSNQDNNDKKFKTIDDSTSDSNNIIDFIYKNLPQTNINQLLTKNKYDDNYSLTTLIQNLFNLNSDISDYEQPRNGEKSTNDSNKNSDNSIKNDTDTQSSKQDKADNQKAPKSNNTKPSTSNKQPNSPKPTQPNQSNSQPASDDKANQKSSSKDNQSMSDSALDSILDQYSEDAKKTQKDYASQSKKDKNEKSNTKNPQLPTQDELKHKSKPAQSFNNDVNQKDTRATSLFETDPSISNNDDSGQFNVVDSKDTRQFVKSIAKDAHRIGQDNDIYASVMIAQAILESDSGRSALAKSPNHNLFGIKGAFEGNSVPFNTLEADGNQLYSINAGFRKYPSTKESLKDYSDLIKNGIDGNRTIYKPTWKSEADSYKDATSHLSKTYATDPNYAKKLNSIIKHYQLTQFDDERMPDLDKYERSIKDYDDSSDEFKPFREVSDSMPYPHGQCTWYVYNRMKQFGTSISGDLGDAHNWNNRAQYRDYQVSHTPKRHAAVVFEAGQFGADQHYGHVAFVEKVNSDGSIVISESNVKGLGIISHRTINAAAAEELSYITGK

SEQ ID NO: 375 - protein, 29 aa, Staphylococcus aureus
SDDKHDFIIEQILSRSCDIESVESWKSSL

SEQ ID NO: 376 - protein, 180 aa, Staphylococcus aureus
MKDEQLYYFEKSPVFKAMMHFSLPMMIGTLLSVIYGILNIYFIGFLEDSHMISAISLTLPVFAILMGLGNLFGVGAGTYISRLLGAKDYSKSKFVSSFSIYGGIALGLIVILVTLPFSDQIAAILGARGETLALTSNYLKVMFLSAPFVILFFILEQFARAIGAPMVSMIGMLASVGLNI

SEQ ID NO: 377 - protein, 107 aa, Staphylococcus aureus
QGHTLGYLYAHQQDGLTQNDIAKALQRTGPTVSNLLRNLERKKLIYRYVDAQDTRRKNIGLTTSGIKLVEAFTSIFDEMEQTLVSQLSEEENEQMKANLTKMLSSLQ

SEQ ID NO: 378 - protein, 256 aa, Staphylococcus aureus
DPSEINKVIHVDLGIIADCKRFLECLNDKNVETIEHSDWVKHCQNNKQKHPFKLGEEDQVFCKPQQTIEYIGKITNGEAIVTTDVGQHQMWAAQFYPFKNHGQWVTSGGLGTMGFGIPSSIGAKLANPDKTVVCFVGDGGFQMTNQEMALLPEYGLDVKIVLINNGTLGMVKQWQDKFFNQRFSHSVFNGQPDFMKMAEAYGVKGFLIDKPEQLEEQLDAAFAYQGPALIEVRISPTEAVTPMVPSGKSNHEMEGL

SEQ ID NO: 379 - protein, 84 aa, Staphylococcus aureus
MTRILKLQVADQVSTLNRITSAFVRLQYNIDTLHVTHSEQPGISNMEIQVDIQDDTSLHILIKKLKQQINVLTVECYDLVDNEA

SEQ ID NO: 380 - protein, 8 aa, Staphylococcus aureus
LEEFIMTT

SEQ ID NO: 381 - protein, 501 aa, Staphylococcus aureus
APNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 382 - protein, 43 aa, Staphylococcus aureus; identical to SEQ ID NO: 245

SEQ ID NO: 383 - protein, 32 aa, Staphylococcus aureus; identical to SEQ ID NO: 246

SEQ ID NO: 384 - protein, 68 aa, Staphylococcus aureus
DQDDVDEHYHIIKDGMVNLQDIVEDIVIIEKPMRAYSEQSDQMLTVGNGWEVIDEDQLDELAKQQATR

SEQ ID NO: 385 - protein, 141 aa, Staphylococcus aureus
EVGDRYYNRTIIYTVYLNYNVDFKRRQYTLAKFLYKMGTFIAKHKWSAVIAWIVIVAAILIPLATNAPKFDNDIKMTGLESLDTNKKIEKHFNQDSEKAQIRVVFKTTKDDGIVQPNITKDIKKTLDDIKKDDKHIDKISD

SEQ ID NO: 386 - protein, 182 aa, Staphylococcus aureus
MKETDLRVIKTKKALSSSLLQLLEQQLFQTITVNQICDNALVHRTTFYKHFYDKYDLLEYLFNQLTKDYFARDISDRLNHPFQTMSDTINNKEDLREIAEFQEEDAEFNKVLKNVCIKIMHNDIKNNRDRIDIDSDIPDNLIFYIYDSLIEGFIHWIKDEKIDWPGEDIDNIFHRLINIKIK

SEQ ID NO: 387 - protein, 55 aa, Staphylococcus aureus
VRYVISIIMGIVLAIWSFKQLSQSHLDSGFIFFFIVYVLCISCFNSDKHDKNKKR

SEQ ID NO: 388 - protein, 257 aa, Staphylococcus aureus
GSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 389 - DNA, 2305 bp, Staphylococcus epidermidis
gatcgcctttacctgaaactgttccagccacttgattatatgtgccccaaggtactgtgtgtaatttaacaccaggtttgacgttgtatgtttgattgatttttacaggtgatttagctgtgttgtaaatgacctcatcttgttttacccaaccataatttgtaccagtattataatcaccaacaagatagaattttttatcaccaagtgtggcagctttcgtcactgacaatgtacgttggatttgatttgttgtctttcctttagtgtcataaactgtagtatataagccactattttttgcattgatttgagcaacaccactattgttagtcactgttaattggttgtttgttgaaggtttagttggattgctaggtttagatgctgtagttaagtaatatttactaatccaaccagatttaccattcactgtaccataaagatacgttgctttatcaatttgttgctgtttagttgctttaaatgtttgatttccagtaccagatactttgctagcaacttgttttggtgtaccccaaggaactgtgtaaagtgttgaccctgctttaacattatatgtttgattcacttttactggtgccttagcagtgttataaacaacatcaccttgtttaacccaaccgtattttttaccgctattgtagtcttcaactaaatagaatttgttatttcctaatgttgcagttttagtaacggatagagttttttgtacttgatcagtcttatgacctttactgtcataaacagttgtatataagccattatttgttggtttaatttgagcaacaccacgattagcagacacagttaacttattattagttcctcctgatggtttagaaggttgtgacggttttgtagatgttgtgccccaaggtgctacttgcttcgttttaattaaatatttttcataaattaagtcatataattctgcatagctataattgtgacttcttaaatattggtgagggtcagcgtgatcagtacctcctaagaagttagagatagcagcatgtgtccaaactgttcctcttccatcgttttcagcgctatcaggttttaaattataatattgcaattgcgttgcagcataatcagcgtagttgttcattgaacgtgcaaatgaatcataatcatgtgtatggacgatttcaacattgataaaacgttgatttccatatggacctgcaccccaagataagtaatctgtcggagctgtttctataattctattgccatcaacaaatgcgtgtacgaatgcatttgtgtaattacgtttcatgaaagcaatctcgccatcgattgttgagttatcatttgcagtatcatgaacaacgataccttcaggacgtcccacaccgtttctatagccatatttagggaaatatgacgtataatcttcttcaattcttggtgctttcatattctttttacgaatatagttatttattgaagaattaacctttggtgtatatttcggtaatgatgatgttttttgactagatacagaataaactgttctcggttgagcagttgcactaaatggggtgaattgctttgtatctatagtcgcttgattagatgccgtttctttttttacagtattagttgttacacgttgagctggttctttatatttatatgaagtagtttgtttagatgtagcattcacattgtttaatgagataggctctaaatggtctgttgagctatcatcgtcttcatcatcgtaatcaaaattataaccagatgcgtttgtatttgatactttaggtgtagcagtttcattttgttcagaagttacttgctgacttttttgttggctttcattatcattagaagcagtttgagtttcaattgcttgattttcggaaggttgacttgcagtcatcttcttgtcttgttgttcattatttgcgttagctcctaaatctttctcattttcttttgctacagattgtgtctcctgtaattgatttgtatcagtggatgttttatcttcttgtgtcaaatcatttgtttcttcttgttgattttttgtaacagaattcgtttgattttgattcgcatcatctgttgataaagattgttgcttttgatttgatgaaatttcattataagtactcatttcatctaatgatgcatcatatgtagtactttgtgtgtcttgtttaggttgaacttgggtagggtcttgatatgtttgtgtaccagatacatttgtagttgattgtgtaacttcgcttttagctttttctgcttgtttgagggcagtttgatc

SEQ ID NO: 390 - DNA, 2848 bp, Staphylococcus epidermidis
gatcatatattatgacgtaaccttcatcatctatttcagctatatctccagtttgaaaatacccatcattatcaaatgtgtcttttaaatatttgggatataaataaccattcatcacattttcacctttaattaataactctccatgtccatatgcgttgggattttttattttcacttcgacattttcacttggttttccaacagtatcgaaacgttctttgagcatttgaggtgaggctgttagaaactgagagcaagtttctgtcataccaaaagaattatatacaggtaaacgataagtcaatgcttgctcaattaattgtggtgataatttagcaccacctagcagaattttttctaaagaaaatggttgagtcaatcctgcatccattaaccactttaacgtttgtggaacaagggacatatgggtgattggataagtctttatttgtgttaacatatcatcagtttgaaactttttaacaagtctgacagtgaatccttctatcactgcgcgcaaaataacactgagcccagaaatatgatatataggtaagaccgaaagccacacagtattttgttcgaatcctaaactttgtttacagcctttagcactggctaaatgattattaaacgtttgaggcacagctttttgaggtcccgtcgttccagacgtaaacataattgatgcaatcgattctaaattaaatttgtaacctgaaacatcatgtttatctaattgtgttaaatcattaaaatgatataaattaaacccttctaattctaaaggcaacgtgtgtacaatcgttgctatgtcgactgaattcatttgatttatcatctcatgtcgcgttaaacgtgtatttatcatagctatttcaatatgagctaaccaacaagcatgaatcaaaacaactgaatcaatatcattgcttatatataaaccaatccttttctgatttaaagaagttaaatattccgcgattgtttttgcacgatgatataattcttcgtacgttaaagataactgatttgtaacaatcgctaatcgatttccatttgattgagcttgttcctgtaaccaaaaattcacaatgcattcctccaaattatatacacgtataattatacctacttgcttattaaatatcagtagttgagcttaatatgttattttcaacttaaagtaatacgtccaaaagtcaatcccctattgaaaatgtggactacatgcgtcaactataagtctttaatgtaatcatgcttttaagttagtaacctacgcaactttcattatcacatttcaattaataatgtgctctatttattttcatcaatcattctattattaactatatatacatttttataagaatcgttctcttttcaaaaagaatcacctcatgaattcattatttaatatattttatttatataatattgtaacaccgtttagtttgttatatttttaaattactttatataacactatggggttttatatgagtaccgaaattgttaaatactttttccgagatatttcaccgaataataaactatagattgaagggaaatagatgaagctacaaaactcactcattctaacattccaataggaataaagagaatttaaactgtaactgataatgtttaatgttactaaattaacagaataaaacttcgtaatgaaaaacaatcaaattatcacttatattacacctgatgttactgaagatgaaatgagagaaattatagcttttatggattaataaaaacaaaagaaaaatagcgataaataaagagagacgcttatattactaatttacactttagtatgattacgtctcttttttatatataaaattacgcataatttaaaccttcatataggagttgattttataaatataatcaatatgcaatttctaaaactaaataaggagtgagaattatgcatcaatataaggagttgattgatgatatagatattaaatatattgaaatgccaaataaattagaatgagtcattttaggtagtgaattatatgttaacagtaaattatcatcaagttcttatgtgagagaagacatcaacacttactatgtactatgtgaaaagtaatttaactaacgcactaatctctttaaatcaaattgaaaaagcaatcaacgctcacgattgcaaaacacttcaagacttgagtaattactttaacttacctactacacatttatttctaacaatgtgattctataaccttaaatatacaaatttgcttttttcaatatattaaaaattaaacctgctacttttcatcaaatagatacacaggaggacgttttatgcaacaagaaacgacatcatggtacaaacaagaatggtttatagttttatcacttttattcatttttccactaggtttatttctcatgtggaaatttagcaagtggccatctattgcaagaacaatcattactgttgcaatttcagttatcgtattagcaagcattacctattatggtaatctacaaatgattgtaccagcaacatcaaattcaaataacgaaactaaagaaactacagagaataatgtaaatgataaagacgagcgaaatcataaaactgcagtagaagaaacaaaaactaattatgactccaccaaagaaaatactaaagaacctggaaaagaaaatgaatctgcaacacgattggagaactctgcgcttgaaaaggcaaagtcatattatgatgattttcacatgtctaaactaggaatttatgatattttaacatctgaatatggagaaaaatttgataaagaagatgcacaatatgctatagatc

SEQ ID NO: 391 - DNA, 2085 bp, Staphylococcus epidermidis
gatcttatctgataatttgacacttaagtcaacatcgcttggtaaaacatctgatgcagctggaatgagtaacacgtcgtcgaatgttaaagattctttagcaaatttattttcccacattaaaaacagcctccaattttatttatacttagttacattatttcacattttcttcagtttgtttatactttataccattaaaaaagaaatttaagatgattgcagaaattgcgccaagcactataccattttgagttaaccaagcaaattgttctcctaatcctttaaatgcttgaggtactgcactaataccagcacctaaccctactgaaattgcaataattaataaattattttgattttggaaattaatgttacccaaaatactaacgccgtatgccataaccattccaaacattgctatcattgctccacctaaaaccggcaatggaataatattagctaaagcacctaatttaggtatacaaccgcaaattagtaaaagaataaccattccatatatcacattgttctttttagctcctgataaagaaacaagacctacattttgggaatatgcagtgtaagggaacgcattaaatattgaacctaaaatgattgctagaccttccgcagtgtacccttttcgaaaatcttttctttctagttttctaccagtaatttcactcagtgcatgatagacaccagtagattcaattaaacttacaactgcaacaatgaaaaatacaagtattgagctgacatcaaatccgaagccagaaaatctgaatggcacagggaaaccaaaccaatgtgcatcacccacttgtttgatatcaaccattccaaatataccagctaaagcagtacctattgctaatcctataagtatcgcaattgatttcaagaagccctttgtaaatctttgcaaaataagaataatgagtagtgtaacaccacctaatattaaattcttagtatcgccatagtttttcgctccttcaccacctgccaagtaattcattgcaactggcattaaattgattccaataattgtcacaacacttcctgttacaacaggtggaaagaatttaactaaataagagaaaaaaggtgcaattaaaacaactaagataccggatattaaaagcgaaccatataaaacatcaagtcctttcgtttgaccgatgagtatcataggtgcaacggcagtaaacgtacatcctagtacaatcggtaatccagtccctgtgactttatttgcttgaagaaatgtcgctaccccgcacataaatatatcaacagtaactagataagcaatttcttcagctgaaaattttaagcttgtccccacaataataggaacaagaatagcccctgcatacatcgctaacaaatgttgcacacttaatatgaaatttttcattacgcttcacctaaaagagttaccttattgccttttaatgaagctaccttacaaagtgaagatacatataagcctgcatcttctaaacgttggcgaccattttggaaacttttttcaaccacaatacccacgccaactgtcgtcgcatttgcttgttttacaatgtcattaagacctagcgaagcatcaccattagctaaaaagtcatcaatgataagtactttatcgtctgcacctaaaaattcttcagatacaatgactgtactcgttttattttttgtaaatgaatgaatatccgtgctataaaagccatctttcaaagtactaggtttagcttttttagcaaatagacaaggaacatcaaaatgaaaagaagccataatagcaggcgcaataccagaagcttcaatagttaaaattttagtaataccagcgtctttgaaagactcataaaatgttttacctacatcattcatcaactttgcatcaatttgatgatttaaaaatccatctaccttcaaaattttctcatcgatgacaacgccatcttctttgacttttcgtcctaacgactccactcaaaaaacctcctcaagtaaattcaaattcgattcctagatacaaaaaaacctcaaactaccattaatagtttcaggatc

SEQ ID NO: 392 - DNA, 2088 bp, Staphylococcus epidermidis
gatcctggtaaagcgattatgacaattaaataaagcctataagaataacttaatggctaaaacaaataagtctgggacaaggatatattatgtcccagactttctttatgtatatacagattcttatgagatgagtccaacacagagaatttccgaagaaattccacggacaaagcaagttggggttggggagaagacaggggacaatgaattctatcctagtttagcgttcattttaataaggggaattttacaaagttgacaagcgtgataattataggcaatgttgatattggacatatcattttaaagagaaaggaaagatggtaatcatggatgacttgaaacaaaatcaatcttctaacgaaaaacctaaaggtaataaaataattaatattttgatattcatcggaatgattttattaattcaaatacctattggcgtgtcactaatagctttacctttttcagtgaaattcagtaagttaacatccatcgcattaagtatgctaataactggtacagcactattaatcatatggttagttaggaattattatttgagtcatacatatgaaagacaatatcaatcaatgaggggaaaagatatctttattaatattggttttctggtattatcaatggtttttagtattctaagtagtgtattaatggtcatatttactggcaacgatactacagcgaatgagaaagaaatcaatgaaagtttagatttacttttacaaaaagaccatttaccacatatttcaattgttgcaactgttgttttaatgatatgtattataggtccgtatttagaggaattactcttccgaggaatttttaaagaaacattatttatgaaatatcgattttggctaccattcattatatcttctattatttttagttcacaacatttatcaacaaatatattttcatatgcaatttattttctaatgggttgtgtattataccttgcctataacagaagacgtaatatcaaagatagtatgatggttcacatgttgaataattctgtttcaacattaccggtatttgttggttatttatggctatattttagatagtaaacataacaataaagacctgattaaaagtagatttatcttttaatcaggtcaattttatatgttaaattgtgatatcattctctatgattaatttaatcgctttatgatctgttgcatttctaaataaatcataggcactttcgatttcactcagtttactataatgtgtcacgagttgttctggttgtattattttgctttttaacgcttcaagtaattcttcagttgtatttcctgaaactaaaccagtagttacgttaatatttttaatccataatttatctatatcaagttgtacaggtaacccatgcacaccaacattagcaatcgtaccatcgacaccaattaaattttgacataaatcaaaggtttgtggaattccgacagcttcaatagcaacatcaacaccacgtggatttaacgattttacctttttaattgcggtttcagtctctttagagttaattaaatgcgtagcacctagttctttagcggtttctaatctattatcatctaaatcaatcataataatttttgaaggtgaatagaattgtgctgtaagtaatgctgctaaacctacaggaccagcacctacaatggctactgtacagccaggtttaactttaccttttaaaacaccaatttcataacctgttggaagtatatctgataacattacaagggcgtcttcttttaaatttgaaggggcgtgatataaagaattatctgcaaaaggaactttaacatattctgcttgagtaccattcactaaatgtcctaatatccatcctcctccgttttcacaatgtgcatagataccttttttgcaatagtagcatttgccacatgatgaaatgcaagagataatcactttatctccaactttgaagttgttaacgttgtcaccaatttcttcaatgattccaataccttcgtgacctagtgtcgtatgtgatttaacttcaggtgtatctccttttatgatatgaagatc

SEQ ID NO: 393 - DNA, 1873 bp, Staphylococcus epidermidis
gatcaattacttgttaatatattacaaccatacgaacaacacataaaacaagaaaatcgtacacttgaagttaatttctgcacagatattgatgcattctaccagtatcgacctccaatcgaacgtattttgaccaatttactagataatgcattaaaattttctaattctggtagccgtattgatattattatttctgagtgtaaagaaaacgacgtcattagtatttcaataaaagatgagggcataggtatcgttccagaacttcaatcacgtatctttgaaagaacgtttagagttgaagattctcgaaatactaagactggtggttcggggttaggattatacattgcaaatgagttagcacaacaaattgacgcctctattacagtccaaagtgatttagacattggaaccacgatgacacttaccttaaaaaaatttcaatttaaaaagtaatttgtattgcattaaaaaaccgaatgtagctggaatgagtttgaacactctagctacattcggttttcattaatgtacacgctctttaaaaccttcatcttgagaataatttgatgcatacgtatcactatatgttttaactttataaaaagaacttaatttatataaatcattactacgcttgttgtttctatttttattcaggtttaaagcattatatctcatgtcgagattctcagtctgaatattagagttttcaacaatatacttcggtctatgtttaacttcataataaatacgaccaatatattctcctactacgccaatagacattaattgaataccacccaacaataatatagcagcaatcgtagtaaaataaccaggtatatttataccattaatcaaaatatttattaataaataaattatatataaaatactgatagaaaacgtgaacatacctaagtatatcatcatgcgtaaaggcttattgttaaaagagatgagtccatcaataccatagttgagtaactttctaaaagtccacttagattctccatcttcacgcgtcacattttcatattgaaatacttttgtttcataacctatccattcaaatagacccttagagaaacgattatattcatcaagtgttgttaaagcttgaactgcacgtcgactgagtaatctaaaatcaccaacgccgtcttcaaattggatatcctctacaaatgcattaattaatttataataacaacgagacaaagttttacgtacaaaattctctccctgacgatttctcttagcaaccacttgatcataaccttcaatgtaaccctctatcatttgtggaatatattcaggcggatgttgtaaatctccatcaatcataatcaccgcgtcgtgcattgtgctatgctgatagccagcaatcattgcagcttctttgccaaagtttcgactgaatgaaagatatttaacatggttatcatacgcaacaatattcttgatatgatgtattgtcgtatctgtactaccatcgttaataaagagtaaatcgtattcataatttttgattaaactatctttcttcattatttcagttaatttgtcataagttttcaaaacgacttcgccttcattatagcaagggacgatgactctgattttcattaaatgacatccttttctctgaactatttgctatcattttatcaatttccttgtcatacattctagttaaatactgtgtatttacataatcttaaattaagcttaatagttttaaatattttcttttatgagcatcacattaacttttagtaaaaagaatttaattatttttttaaagttaactctaactgattaattatatttatttcaaatctccaatactgacatcatcaggatc

SEQ ID NO: 394 - DNA, 2108 bp, Staphylococcus epidermidis
gatcagttgattggtgtgtcgattgtgacattataataactccttttctatattaaataattaggtaataaaaattttacaacactataaagaattacaaaagtatttaagttcataaattctaaatatatagaagttttagaaaactcattacattgaactttactttattacaatttatctaataaatattaagaaaagtaacgaaatatgtcttataaatagcgatatatcaactttctttaataaatgttcagaacaatacattattttaacaatgttacaagataataacaaagcccacaaagtcaaatatttttgttagtatggggtacgtaataaaaaaacaaaaagttaatgtacagagacttgtcgggacaattatctaaatcattaaacttaaatcaattaaatctttgttatatttaaggaggagttactttgaaaaagttagcctttgcaattacagccgcttcaggcgcagcagcagttctatcacatcatgatgctgaagcttctacacaacataaggttcaatctggagaatccttatggactattgcacaacaatacaatacttcagtagaaagcattaagcagaataataatcttagcaacaatatggtattcccaggacaagttattaatgtaggtggaagtgcttcacaaaatactagttcaaacacttcttcaagttcagcatcttcacatactgtagtagcaggtgaatcattaaacatcatagctaataaatatggtgtttcagttgatgcattaatgcaagcaaatcatctaaatggttatttaattatgcctaaccaaatattaactatccctaatggtggttctggttcaggatcaggtggtacagcaactcaaactagcggtaattatacttcaccttcattcaaccatcaaaacttatacactgaaggtcaatgcacatggtatgtgttcgacaaacgttcacaagctggtaaacctatcagtacttactggtctgatgcaaaatactgggcgtcaaatgcagcgaatgatggttatcaagttgataatactccatctgttggtgcaattatgcaaagtacacctggaccatatggtcatgtagcatacgttgaacgtattaatggtgatggtagtattttaatttcagaaatgaattatgcaaatggtccatacaatatgaactatcgtactatcccagcttcagaagtatcttcatatgcatttatccactaatcattgatgattaatgattttactacaaggtaatggaatataccttgtagttttttattttaatagaatgattgaacctcattattttatattttaagcaattcaaataaaaaggccacacaaagttgactaaaaatgtcagtctttgtgtggcctttagctatatgtacttacgtattatacaaaccttttttattttaagaacagatgaataataaaataaataattgctgctaaaacagctgagataggtaaagtaatcacccatgttacaaccatacgttgagcagtactccatttaacacctttcgcacgatttgaagcacctacacctagaatagatgaagacacaacgtgtgtagtagataatgggaaatgtaatgatgacgctacgaaaatcgttaatgctgaagaaatatcagcggctgcaccgttagcaggtctaattttcataatatttccgccaacagttttgatgattttccaaccacctactgctgtacctaatcccatagctgttgcacacgcaactttaacccatacttgaggttcaacattactaccatcttgtaaattacctacaattaaagctaatgtgataatacccatagatttttgagcatcgtttgtaccatgtgagaatgattgtaatgctgcagtaaagatttggaaaaacctaaaattacgattagtacgtgttaaatttgaatttttaaaaacgattttaacaatcgtatacatcatataacctacacaaaaagctataattggtgaaatgattaatacgataataatttttgtaaaaccttgatagtgtaatactgcaaacgaaccttgcgatgcaatggctgcacccgctatagatc

SEQ ID NO: 395 - DNA, 2159 bp, Staphylococcus epidermidis
gatcatattattagagcttatcacaagtttttgcaaagtggttaccaaacagaattacatttatttggtagagatgaagataatcaaattccattgatgaatactttgatttcagaattaaaattatcggataaagttaaaatatttaaatataccaatcaacctttacaagaatttaagaattctaaagcctctctacttacaagtcaatatgagggatttggcttaacacttatggaaagtatagaaatggggtgtccagtcctatcttataacgttcgttacggtccaagtgaaattattcaaaacgggataaatggctatctcattgaaaaaaatgatattgatagtttatcaaaacatatgattaacatcattgagcacccactacaaaaagtgaaaaataaagacactttaaaatataacgccgcagtgaataattacaaacaacttatgcaaagcttagacttattaaaatagtcaagttttccgatattataaagatttggtagcatctttataaaactataattaagcccattgatgattcttaatccaatcatcaatgggcttaatttgatagttatatattgttaaacaattttcttaatgaataaatttgtaatttctcacttgataagctggaattgttctatatgtcatatttccaggagctgcactccagttcatttctgaaactaaaatacttccatcgctattcacgcgctctacaaacgctacgtgaccatagtaaccagcgtcagtttgtgcaattgagcctactgtaggacgataatcaatagtatatccatcagcagctgatgcattgtcccaattatttgcattccaccagtatgtactgataccttttcctatttcagcacgtctattaaatacgtgccatgtgcattgtccccaagtatacaagttttgatggttaaaagttggtgaataatagccaccgtttgatctagtattattagaagatgagctactagaactacctccaggcacttttaacttctgtccaggatagataaagaaattagttaatccatttaattgcataattttttgatacgttgtcccatatttactagcaattgcagatagtgagtctccatacttaacagtatatgttgcagtacgaccactagacccactagcttttgcacgactggaactcgtcgctttaccagaaactttcaacttttgtccagggaaaataagatagttatttaacccattaagttgcatgattttttgataagttgtaccgtattttgcagcaatagaagataatgaatctccagctttaactgtataaactgtgccactatttgttgacgttgctcttgaagatgagcctgatactttcaatacttgattagggaatattaaattggaagtcaatccattaagtgattttaatttagcaatactaatcccatatttgtgagaaattgaccatacagattctccactttttactgtatgcgttgttgcagcttgtgcatgagttgatgccaatgcgctaagggcagttgttccaataatggcagtaatatattttttttgcacttgaaatcctcctctactttaggttttgtttattcgcgttttaacaatacaaagatattatactctttaattatgtatagcatgtttgctttagatgacattctgattacaaatattattttaaataaaaaatagggctacgctcaaacatatttgcatttatccaatttaatacattttgcagtcaattacaatgtcttttttatcacaattattattaatatggtttcgcaccttatatttacaatttcgaatgtaatgttttttctattttcaaattaatattaaatggacagacgcttatttctagattctaaatgcaacatttcgaataaaaaaagaagtaggaatagaattcgctatgaattctttatcccacttcaaaaaggtaaaatgccatgaaagatatagaaatatatcttcaacttagtcattgactataaaattgttttgcaaccatcacatataactggaattctagactaaaaatttctatatggtgaatgttgcgctaaaactttatattatttttttgccaactcattttcgatttcttcgatttcctttttagaaagatc

SEQ ID NO: 396 - DNA, 2680 bp, Staphylococcus epidermidis
gatcaattcagagaagcaatgacaaaattcccagtttggatgggtgctactaccctattcttcggtgccataaatggtgctaaagaaatgcttgatgtaattactgaaattgatggaaaaatgattactcttgcaaaagttactggtgatgacaatgcacttcaacaaacatttattgacgcaaataatgctgcttctcaattcggacagacattaggaagcgtattagatgtatatgcagaattcgctagacaaggtgttaaaggtaatgagttatctcaattctcaaatgcagcattaattgctgctaacgttggtgagattgacgctaaacaagcttctgaatatttaacttctatgtctgctcagtgggaaacgactggaaaccaagctatgagacaagttgactcactcaacgaagtttccaataaatatgctacaactgttgaaaagttagcacaaggtcaagcaaaagctggctctactgctaaatcaatgggacttacttttgatgaaactaatggtattattggtgcattaacagctaagactaagcaatctggggacgaaattggtaactttatgaaagccactttacctaaactttatagtggtaaaggtaaatcaactattgaaggcttaggcattagtatgaaagatgaaaatggacaattaaaatctgccatttctcttttagaagaagtttctcagaaaactaaaaacttagaaaaagaccaaaaagccgctgttataaatggcttgggtggaacataccactaccaacgtatgcaagtattattagatgatttatctaaaacagatggcttatataaacaaattaaagaaagttccgaaagttcagctggctctgcattacaagagaatgcaaaatacatggagtcaattgaagctaaagttaaccaagcaaaaacagcattcgaacaattcgcattagctgttggtgaaacatttgctaaatcaggaatgcttgatggtatcagaatggttactcaacttttaactggtttaactcatggaattactgaattaggcacaactgctccgattttcggcatggttggtggtgctgcctcattaatgagtaagaatgttagaagtggttttgaaggtgctagaagtagtgttgctaattatattactgaggtaaataaattagctaaagttaacaatgctgctggtcaagttgttggacttcaaaaagttcaaactggtacagcttcacaacttcagtttaataaaaatggtgaatatgataaagctgcttcacaagcaaaggctgctgaacaagcaacttaccaattctctaaagctcaaaaagatgtatcagctagtgctatgatcgcttcaggtgcaatcaacaaaacaactgtggctaccacagcaagcactgttgccactcgtgctgctacacttgcagttaatggtttaaaattagcctttagaggcttgttggctgctactggtgtcgggttagcaataactggtgtttcttttgtactggaaaaagttgtaggtagttttaatgctgcaagtcaagctgctgaacaatataaacaaaaacaagagcaaacgaagcaagcaatagcttctatgagtaatggtgaaattaattcacttattagtagttacgataaactacaacaaaaaatgaattctggtagtgcatttaatacagcggaagctgagaaatataaagaagtaacaagtcaattagctaatatattccccgatttagttactggtgaaaaccgttatggtaaggaaatggccggtaataaagaagtaatgaaacagaaaattgagttaatcaagcaagaaatggagcttgaaagacaaaagaatgctatcaaacaaaaagaagagcaagacgcttacatcaaagaacaagatagcttagctaagaaaaacagaggtcaaaaatggtatcaacttggtcaaacaccagagttgaaacttcaggaacaagcacgtcctactactgtttctgataatagtaacattaacaaaattaatgccactatccaaaaagtgaagagtcaagcccaagctgaaaaagcattagaacaagttgataagcaacttgctcaatctcaaactaagaatagacaaaatgaagttcagcacttacaaaaagttagacaagctttacaagattatattactaaaactggtcaagcaaatcaggcaacaagagctgcggtattaactgcacagcaacaattcactaaccagatagcaacaatgaaaaagcttggtactactggtcaacaagtgatgactactatttctaactcagttgcgaaaacagcaaagtctggtaaagctgctcaagcaaccttcaagtcgtttgaaacctcattagttaaaagctcttcattcaaaagcaagatggctagttatgaagcttctgttaagaaatttaaaaatgctgctaaccaatctgctaaaattgctgctcttaaagacgtagaacgtgattactctaaagttgctaaaggtattatgcaagcggcaaaagcggcaaacatgagtaaatctcaaatgaaagatttgaaaaaatctcttcaacaaaatatacaagcagaaacaggctttagagcttcagtaagtaaagctggtaaagttactattgatcaatctaagaaaatcaaacagaata

SEQ ID NO: 397 - DNA, 1948 bp, Staphylococcus epidermidis
gatcaattttcaaatcgcctagtcctagcgctcatcattgtatactcagttatgtcgttgtgtcccgttctaacatttgctttttagtaataatggggtactttttgaaaacaatagaccctacaataccagcaatagttcctataatcgccataaccacaccatagataatcactttcgttaaactattaaaaccaaacatcactaaaaaacctgcaataggtgtagcagtgccagttgcattattaatcatacctgaccaagcaattataataccggcaattgccccaccaaagaaattagtgacataaataggaataggattagcggaaacaatatcagcttgagaaagcggttcgattccgactgaaatggttgatttacggtctcccaatttcaaacgatggaacaatgcactattcataaacgcggaactaaatgcggccatggcacctatagccataggcgcacccgttaaaccaagcaatgcagtgagagccattgaacttaatggagcagtacctactactgtaataatacctcccaatacaattcccataatcaacgggttagcatctgtactactttgtataatatccccaattttaattaacgtgttattaaccactggcgtcaatccagtagcaattaacctagctataggtgcgagaagaatgattgaaccaattaaatcaataccgtctggcacatatttctcggtatacttcatcatgtagcctacaatatacccagcgaaaaatcctggtaacaagtccatacctccacaagctgccccaataactagtgcataaactggagataccccaatcgctaatgcagttaatccagccgcagccacaccacctaaacctccagcagcatctcccagttcttctaagaatttaatcccaaatacttgaccacccacatatttattgaaagcttcaactaaaaacgatgcaatcgccgcattcgctaaagctcccatcgccctcatcccactaggtgctttgtatgtaaatagagtaaaaataactaaaactaaaattaaaaataaagtacctataagcaaatccatatcaaacactccccataacacttataattttctgattttttagaaaacaactataaaatacatagtaccaaaaaaatatacctttgaggagaattttttaaaaaatagaaaatatttattaaattaaataaagttaaatagtaaaaattgtgacaagcttcaacttactctaccaatggagacatttattagaattcctcaaattaatcctccacgacatattaatgaaatgattgaaacgatacacaatcgtgattttgatgaattcagttctctaaaaagaacaatttaaatttttaataaatcaatcataaatatcaccttttttcaaagcaagatttgtatttgcgagttcttccataaattgtgagtcatttaaaacatcgaatggtttattaccttcgcctattaaaaatctaaaatgagtaatattcataaattcaaatattaatttaaattggtggactaaaggttgtgctttgatacgtggactgtcaccgcctatgattaaaattaagttttttttgtgacataatttctttgaagttatctatttgcgtatctcgcaatgattcagtccatctatcaataaagagttttaaagacgcactcatggaataccaatagagaggcgttgagaaaattataatatctgattttaaaactttatttaaaatttttttataatcatcattatgaatgctagtttcattgctatgacgattatcattaaccttttcaatgttactttggtataaatttataaactttccatcaattagtacattttattattatcaataggttttaaaaatccaaagttaagtagttgaactagacctaaaaagacataaataaaaaatcaagatc

SEQ ID NO: 398 - DNA, 2132 bp, Staphylococcus epidermidis
ttgatccgataactacgccaatgattgtaagtatgacaagtgctcgattaggtaaatgtttgtgattcaattgacttaaccaagaagggagtaaaccatctcgtccaaatgaatataatagacgtgaacctgcaagcatcataccgattaatgcagtgaacataccgatgacagaaattgcttgaacaattgcagcaataataccatgaccactttctcgtaatgcccaacctactggctctgcattatcagcgtattgagagtagtggaacatgccaacaagaacaagtgctacggccacaaacaatacaattgctactatgagtgaccctaaaattcctctaggcattgtcttctgtggattaatcgcttcagctgaattagcagcaatagagtcaaaaccaatataagctaagaaaatcattgaaactccagcataaataccttgccaacctccaaagtcgccagtttcagtaaccttatgttctggaataaatggtatatagttactgaaattaatcgcagttagcccaacaatcacaaataaaatgatggctaacacctttaatataaccaatacattttccatacgagcggcttcgttcattccgcgtgataatagtaatgcagttaaaataatcactacagcagcaatgatatcaatgacaccaccgttacttccaaatggattagataatgatttaggtaaagaaatgcctaatggtgcaataagacctcttaagttagcagaaaagcctgaagcaacgaaagcaacagcaataaagtattctgctaaaagcgcccaaccggcaacccatccgaataattcaccaaaaagtacattaatccatgaataagctgatccagcaaaaggcattgtagatgccatttctgcataagtaaaggctacaagacctgcaacaatggcagctaataagaatgataatgccacagcaggtccggcatgctcagccgcgacaacacctggtaaagtgaagatagatgtagagacaattgtaccaacacctagtgcaagaaagtcacgtacacgtaacgtgcgcttaagatgcccatctttattttgataaatagtaggattctcttttcgagtcatccgattaaaaaaacttcccataacaaacctccataacatcaacttactattaacatgagtcagcaaacattccttaacaatacgtattaaaaaatcatctacatgtagataaaatgaattggctgattctgataattaatataatagcacagaagatgaatattttgtctaaaaattctgaaaaatcaataaaaattattttcctcagtgattaagttaatatagtaaaatttcaataggctaaaaaggatataaattgaatgttaatatcacaggaattttcatttatggtatttgtcatgtatttcttcacatgatttataaattagtaaagtaattatatttggaaaacatgttatcgtaaaagagagcatcatgataatgatgaaaaataatcggtattagtcaattaaaataattatatacacggaaatattgtttaatgagtgttagtgtatatgaataattgaagaagttatgttaaaaaaatgctagatatcaaacgatggttctatgagagaagttatccatcaatcaaatgttgataattaaggatgaatataaatggaaattaaacaaattaaatatttcgtagaagttgtacgacaaggtggtatgacgcaagcatctgaacacttatacattgcacagtcaacgattagcaaagcgattaaaaatattgaaaatgaatatgatattacattgtttgaccggtcacaaaaacaaataaaactaacagatataggtcaaacattttatgataatagtttagaatttttagctttattcgagaaattatctttagaaatgaatgacattgtgaacgttcaaaaaggtcatattaaaataggcttatcaccaatgatgaatgttcaaatgtttacaaatgcattgaatcagtttcacagactctatcctaatgtgacatatgaagtgattgagggtggtggtaaaattgttgagaacttaacatctaatgatgatgtggatattggtattactacattacctgtagatc

SEQ ID NO: 399 - DNA, 2563 bp, Staphylococcus epidermidis
gatcctgaaacactatttattgtgatgagtcaaatattatttcatccgcttgtaggtggatttttattagcagccatccttgctgcaataatgagtactatctcttcacaattactagtaacatcaagttctttaactgaagatttctataaactaatcagaggttcagataaagcatcatcacaccaaaaagagtttgttttgattggacgcttatcagttctacttgttgcgatagttgctattacgattgcttggcatccaaacgatacaatactaaatttagttggtaatgcttgggctggttttggagctgcatttagtcctttagtactctactctttatattggaaagatttaacacgtgcaggagctattagcggaatggtagctggtgctgtagttgttattgtttggatttcttggataaaacccttggctacaatcaatgcattctttggtatgtatgaaatcattccaggtttcatagttagcgtattgattacgtacatcgtaagtaaattaacaaaaaaacctgatgattatgttattgaaaatcttaataaagttaaacacgtcgttaaagaataaatgtacaattatcagactatatcaaaattataatattgattaattaaataacaattacaagtataatttaaatatttctctaatatacagtgtcaatttattttattcacataagaaaatagctatgaagaaatctatcaatttaaatttcttcatagctaatttttttcatttaaatttattgacggcttgaaaaatgagtcaaaatcatcaataacatcaaattgcaaatatattcctttggtaatggattgaccattaaacttaattcgaattctattctattcttttctatacaatgaaacgggtgtcatacatcatcagtaactaattatgatagatatgaacttgtggttctttatcgtctttagttttactaatgagagcacgtggagtatttccatctttgattctaatttcatactcatctagtttatcaaaatatttttcggcttgctctgtaacatattgtgtaatacctatcgtttctgcctgtccgtaataatctataggcaaatcaactgtaagttgtttagcttttttatttacgaatttaaccttaccaactgcttgtgtgaagtttgaaaaatacgattgcaaattatcattaaactgtttaaagttattattcagcgtttcatcataatcagctgcagttgacgaaggaattaaggctgctttttcattaatattatcccaagagttaattttagttttaccctcttcaaccgtagtaccaactataaattcacctggtgtaatggaatcttgacttgattgtttatagatagcaaaatgaataggaatatctttcaaatcactattctcacgtaaacgagaaagcatttcactagccatctgtttaccttgcttttcaatctctttatcagataaatctttactaaatgtttcgccatctttctcttttttgtaataataaacactattcatggctaaaccaattgtcatcccttttatatttttacctttagaatcactatttccataaaaatcctgctcgagtatatttgaaagataggctggagaattttcagctattttctcttcatctgtttcaccattgtgagatggattgagtccaagattctcattagcatttttgcttttcttttctttttcgctcatcttgtcaatttcttttttcgtatacttcggatctaagtatgcattaatcgtttttttatctaaatattgtccatcttgatataaatacttatttgttggaaagatttctttacttaattctagtaaaccactttcaaaatcttctccattataaccatttgccatattatcttgtaataatccacgagcctggctttctttgaagggtaatatagtcctatagttatcaccttgaacttttttatcagtcgctatttgtttcacttgatttttattatggttatccttatgttcactttgttctttatctgatgaagtttgtttatgtccatctccgcaagccgttaataataacagtatcgacatgagtaaaaatattgttcgcttcattcacgtactcctctaattattagattccattttgtttttcaataaatgctgcttcagtccaaatttcagtaccatacttctcagctttggctaatttagaccctgcatctgctccagctatgacaatatcagtacttttagtcacgctgtttgtaactttagcaccttgcattttcaaccattcagatgcttcatttctcgtcatttgctcgagtttccctgttaatacaattgttttcccactaaaatcaggatgaccttcgatttcagttgttttaattcctttataagacatattaacatttttattacttaatttttcaattaatgaacgaatatcactattttcgagatatgttacaacagattgtgcaagtttatctccaatatcttgaatttcaattaattcactttcagttactttaaaaagttgatc

SEQ ID NO: 400 - DNA, 2284 bp, Staphylococcus epidermidis
gatcctgacacagctatttctctcttagataatcctattcaacctttacctaataataaagaaagtataattagatacatcaaaggggcaatctagtatggaggaagttttaaaacttaaaatccctgcatcaaccgcgaatctaggtgtaggttttgactcaattggtatggcattggataaatatttgcatatgtctatacgtaagattgaaagagctaattgggaatttctatattatagttcagaactagaaggtttacctaaagatgagaataattatatttatcaaactgctctaaatgttgcgcgtaaatacaatgttacacttccaagcttgcaaattgaaatgagaagtgatattccattagctagaggactaggttcatctgcctctgcattagtcggtgctctttttattgctaattactttggtaatattcaattatctaaatacgaattgttacaactagcgactgaaattgagggacaccctgataatgtagcacctacaatatatggaggtttgattgcaggtttttataatccaataactaaaataacagatgttgctagaatagaagttccgcacgtagatataattttaactatacctccatatgagcttcgtacagaagactctagaagggtcttacccgatacattttcacataaaggtgctgtgcaaaatagtgccattagtaacactatgatttgtgctctcattcagcataaatataaacttgctggaaagatgatggaacaagatggttttcatgaaccatataggcaacaccttattccagaattcaatcaagtacgtaaactatcacgtcaacatgatgcatatgcaactgttatcagtggagctggacctacaatactcactctttgtccaaaagaaaaaagtggtaaattagttagaacactacgtgagaaaattaataattgtgcttcagaactagtaacaattaatgaaataggtgttaaagatgaagtggtgtacctaaagtcctaaattattgtaaaatatagttaagaataaacttttaataactcttgaaaggagttctatactatatgactcagtataaaatggtagttttagatatggatgatactttaatgaatagtgataataaattatccattgagacaaaatcttacttattagatattcaaaagcgtggttattatgtagtattggcctcaggtagaccaacagaaggtatgttacctactgcgagagaattagagttaaataaatataacagcttcattattagttataatggaggtaaaactataaatatggctaatgaaaatgtagaggtcgatcagcctgtttcaaaggaagatttcgataatattgtagattattgtagagataagaactttttagtacttacttatgataatggatatatcattcacgatagtagtcatgaatatatgaacatagaatcacaacttaccggattacctatgaatcgtgttgctgatttgaaggaatatattaatcatagtgtgcccaaagttatgggtgtggattatgtaggtcatattaccgaagcacgtattgaattggatggttacttcaataatgatattgatgtgacaacgagtaagccttttttcctagagtttatggcaaagaatgtttcgaaggggaacgcaataaaagcactttgtaaaagattacaaatttctctagaagaagttatagtattcggggacagtttgaatgataagtcaatgtttgaagttgctggatattctgtagcaatgggaaatgctagtgatgaactcaagaaaattgctgacgaggtaactttagataataattctaacggtattccttatgctttaaaagaacttttggtttaaagtattattacaatgaattaatatgtaaattaataattttaaggttaattgaatctgacttctctaaatataagtagtaagtcataaaaaactgtcgatataaatataattaaaaaattttctttttaatataatatataagtctgagacataatctagaataatagcccgtaaatgaattttcaaaatttatttacgggcttctttattcataatataagttacataattaaccttcatccatgcctacaatttctttattgaatatatttaaatctttatttactttttctttcaaatcaattgaaaatcgagactttcaattgatttgctatttcgcagtatgtgtccagtcatgttttcctttatagcgtttaacatgtgcatatacttgatc

SEQ ID NO: 401 - protein, 769 aa, Staphylococcus epidermidis
DQTALKQAEKAKSEVTQSTTNVSGTQTYQDPTQVQPKQDTQSTTYDASLDEMSTYNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYNFDYDDEDDDSSTDHLEPISLNNVNATSKQTTSYKYKEPAQRVTTNTVKKETASNQATIDTKQFTPFSATAQPRTVYSVSSQKTSSLPKYTPKVNSSINNYIRKKNMKAPRIEEDYTSYFPKYGYRNGVGRPEGIVVHDTANDNSTIDGEIAFMKRNYTNAFVHAFVDGNRIIETAPTDYLSWGAGPYGNQRFINVEIVHTHDYDSFARSMNNYADYAATQLQYYNLKPDSAENDGRGTVWTHAAISNFLGGTDHADPHQYLRSHNYSYAELYDLIYEKYLIKTKQVAPWGTTSTKPSQPSKPSGGTNNKLTVSANRGVAQIKPTNNGLYTTVYDSKGHKTDQVQKTLSVTKTATLGNNKFYLVEDYNSGKKYGWVKQGDVVYNTAKAPVKVNQTYNVKAGSTLYTVPWGTPKQVASKVSGTGNQTFKATKQQQIDKATYLYGTVNGKSGWISKYYLTTASKPSNPTKPSTNNQLTVTNNSGVAQINAKNSGLYTTVYDTKGKTTNQIQRTLSVTKAATLGDKKFYLVGDYNTGTNYGWVKQDEVIYNTAKSPVKINQTYNVKPGVKLHTVPWGTYNQVAGTVSGKGDR

SEQ ID NO: 402 - protein, 145 aa, Staphylococcus epidermidis
RIGGKYMDNIKIIVASDSIGETAELVARAGVSQFNPKQCKHEFLRYPYIESFENVDEVIQVAKDTNAIIVYTLIKPEIKKYMISKVNEHALKSVDIMGPLMELLSNSIEETPYYEPGMVHRLDDAYFKKIDAIEFAVKYDDGKDR

SEQ ID NO: 403 - protein, 90 aa, Staphylococcus epidermidis
GEAFMVKNMDTIVQLAKHRGFVFPGSDIYGGLSNTWDYGPLGVELKNNIKKAWWQKFITQSPYNVGIDAAILMNPKTWEASGHLGNFNDR

SEQ ID NO: 404 - protein, 209 aa, Staphylococcus epidermidis
RPIELSQRQEQIIEIVKSEGPITGEHIAEKINLTRATLRPDLAILTMSGFIEARPRVGYFYSGKSKNKIINEKLRKYVVKDYMSHPVVIKENMTVYDAICTIFLEDVSTLFITNENNDFVGVCSRKDLLRASMIGEDIHTMPISVNMTRMPHVSYLKEQELVIYAANQMIDKEIDSLPIVRPKENDKFEVIGRISKTTITKLFVSLFKE

SEQ ID NO: 405 - protein, 424 aa, Staphylococcus epidermidis
SVMKNFILSVQHLLAMYAGAILVPIIVGTSLKFSAEEIAYLVTVDIFMCGVATFLQANKVTGTGLPIVLGCTFTAVAPMILIGQTKGLDVLYGSLLISGILVVLIAPFFSYLVKFFPPVVTGSVVTIIGINLMPVAMNYLAGGEGAKNYGDTKNLILGGVTLLIILILQRFTKGFLKSIAILIGLAIGTALAGIFGMVDIKQVGDAHWFGFPVPFRFSGFGFDVSSILVFFIVAVVSLIESTGVYHALSEITGRKLERKDFRKGYTAEGLAIILGSIFNAFPYTAYSQNVGLVSLSGAKKNNVIYGMVILLLICGCIPKLGALANIIPLPVLGGAMIAMFGMVMAYGVSILGNINFQNQNNLLIIAISVGLGAGISAVPQAFKGLGEQFAWLTQNGIVLGAISAIILNFFFNGIKYKQTEENVK

SEQ ID NO: 406 - protein, 192 aa, Staphylococcus epidermidis
VESLGRKVKEDGVVIDEKILKVDGFLNHQIDAKLMNDVGKTFYESFKDAGITKILTIEASGIAPAIMASFHFDVPCLFAKKAKPSTLKDGFYSTDIHSFTKNKTSTVIVSEEFLGADDKVLIIDDFLANGDASLGLNDIVKQANATTVGVGIVVEKSFQNGRQRLEDAGLYVSSLCKVASLKGNKVTLLGEA

SEQ ID NO: 407 - protein, 46 aa, Staphylococcus epidermidis
NWRLFLMWENKFAKESLTFDDVLLIPAASDVLPSDVDLSVKLSDKI

SEQ ID NO: 408 - protein, 266 aa, Staphylococcus epidermidis
YWTYHFKEKGKMVIMDDLKQNQSSNEKPKGNKIINILIFIGMILLIQIPIGVSLIALPFSVKFSKLTSIALSMLITGTALLIIWLVRNYYLSHTYERQYQSMRGKDIFINIGFLVLSMVFSILSSVLMVIFTGNDTTANEKEINESLDLLLQKDHLPHISIVATVVLMICIIGPYLEELLFRGIFKETLFMKYRFWLPFIISSIIFSSQHLSTNIFSYAIYFLMGCVLYLAYNRRRNIKDSMMVHMLNNSVSTLPVFVGYLWLYFR

SEQ ID NO: 409 - protein, 310 aa, Staphylococcus epidermidis
DLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKELGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 410 - protein, 378 aa, Staphylococcus epidermidis
QIVQRKGCHLMKIRVIVPCYNEGEVVLKTYDKLTEIMKKDSLIKNYEYDLLFINDGSTDTTIHHIKNIVAYDNHVKYLSFSRNFGKEAAMIAGYQHSTMHDAVIMIDGDLQHPPEYIPQMIEGYIEGYDQVVAKRNRQGENFVRKTLSRCYYKLINAFVEDIQFEDGVGDFRLLSRRAVQALTTLDEYNRFSKGLFEWIGYETKVFQYENVTREDGESKWTFRKLLNYGIDGLISFNNKPLRMMIYLGMFTFSISILYIIYLLINILINGINIPGYFTTIAAILLLGGIQLMSIGVVGEYIGRIYYEVKHRPKYIVENSNIQTENLDMRYNALNLNKNRNNKRSNDLYKLSSFYKVKTYSDTYASNYSQDEGFKERVH

SEQ ID NO: 411 - protein, 152 aa, Staphylococcus epidermidis
DQLLVNILQPYEQHIKQENRTLEVNFCTDIDAFYQYRPPIERILTNLLDNALKFSNSGSRIDIIISECKENDVISISIKDEGIGIVPELQSRIFERTFRVEDSRNTKTGGSGLGLYIANELAQQIDASITVQSDLDIGTTMTLTLKKFQFKK

SEQ ID NO: 412 - protein, 223 aa, Staphylococcus epidermidis
SIAGAAIASQGSFAVLHYQGFTKIIIVLIISPIIAFCVGYMMYTIVKIVFKNSNLTRTNRNFRFFQIFTAALQSFSHGTNDAQKSMGIITLALIVGNLQDGSNVEPQVWVKVACATAMGLGTAVGGWKIIKTVGGNIMKIRPANGAAADISSALTIFVASSLHFPLSTTHVVSSSILGVGASNRAKGVKWSTAQRMVVTWVITLPISAVLAAIIYFIIHLFLK

SEQ ID NO: 413 - protein, 270 aa, Staphylococcus epidermidis
GGVTLKKLAFAITAASGAAAVLSHHDAEASTQHKVQSGESLWTIAQQYNTSVESIKQNNNLSNNMVFPGQVINVGGSASQNTSSNTSSSSASSHTVVAGESLNIIANKYGVSVDALMQANHLNGYLIMPNQILTIPNGGSGSGSGGTATQTSGNYTSPSFNHQNLYTEGQCTWYVFDKRSQAGKPISTYWSDAKYWASNAANDGYQVDNTPSVGAIMQSTPGPYGHVAYVERINGDGSILISEMNYANGPYNMNYRTIPASEVSSYAFIH

SEQ ID NO: 414 - protein, 159 aa, Staphylococcus epidermidis
DHIIRAYHKFLQSGYQTELHLFGRDEDNQIPLMNTLISELKLSDKVKIFKYTNQPLQEFKNSKASLLTSQYEGFGLTLMESIEMGCPVLSYNVRYGPSEIIQNGINGYLIEKNDIDSLSKHMINIIEHPLQKVKNKDTLKYNAAVNNYKQLMQSLDLLK

SEQ ID NO: 415 - protein, 330 aa, Staphylococcus epidermidis
SRGGFQVQKKYITAIIGTTALSALASTHAQAATTHTVKSGESVWSISHKYGISIAKLKSLNGLTSNLIFPNQVLKVSGSSSRATSTNSGTVYTVKAGDSLSSIAAKYGTTYQKIMQLNGLNNYLIFPGQKLKVSGKATSSSRAKASGSSGRTATYTVKYGDSLSAIASKYGTTYQKIMQLNGLTNFFIYPGQKLKVPGGSSSSSSSNNTRSNGGYYSPTFNHQNLYTWGQCTWHVFNRRAEIGKGISTYWWNANNWDNASAADGYTIDYRPTVGSIAQTDAGYYGHVAFVERVNSDGSILVSEMNWSAAPGNMTYRTIPAYQVRNYKFIH

SEQ ID NO: 416 - protein, 894 aa, Staphylococcus epidermidis
DQFREAMTKFPVWMGATTLFFGAINGAKEMLDVITEIDGKMITLAKVTGDDNALQQTFIDANNAASQFGQTLGSVLDVYAEFARQGVKGNELSQFSNAALIAANVGEIDAKQASEYLTSMSAQWETTGNQAMRQVDSLNEVSNKYATTVEKLAQGQAKAGSTAKSMGLTFDETNGIIGALTAKTKQSGDEIGNFMKATLPKLYSGKGKSTIEGLGISMKDENGQLKSAISLLEEVSQKTKNLEKDQKAAVINGLGGTYHYQRMQVLLDDLSKTDGLYKQIKESSESSAGSALQENAKYMESIEAKVNQAKTAFEQFALAVGETFAKSGMLDGIRMVTQLLTGLTHGITELGTTAPIFGMVGGAASLMSKNVRSGFEGARSSVANYITEVNKLAKVNNAAGQVVGLQKVQTGTASQLQFNKNGEYDKAASQAKAAEQATYQFSKAQKDVSASAMIASGAINKTTVATTASTVATRAATLAVNGLKLAFRGLLAATGVGLAITGVSFVLEKVVGSFNAASQAAEQYKQKQEQTKQAIASMSNGEINSLISSYDKLQQKMNSGSAFNTAEAEKYKEVTSQLANIFPDLVTGENRYGKEMAGNKEVMKQKIELIKQEMELERQKNAIKQKEEQDAYIKEQDSLAKKNRGQKWYQLGQTPELKLQEQARPTTVSDNSNINKINATIQKVKSQAQAEKALEQVDKQLAQSQTKNRQNEVQHLQKVRQALQDYITKTGQANQATRAAVLTAQQQFTNQIATMKKLGTTGQQVMTTISNSVAKTAKSGKAAQATFKSFETSLVKSSSFKSKMASYEASVKKFKNAANQSAKIAALKDVERDYSKVAKGIMQAAKAANMSKSQMKDLKKSLQQNIQAETGFRASVSKAGKVTIDQSKKIKQNR

SEQ ID NO: 417 - protein, 349 aa, Staphylococcus epidermidis
VLWGVFDMDLLIGTLFLILVLVIFTLFTYKAPSGMRAMGALANAAIASFLVEAFNKYVGGQVFGIKFLEELGDAAGGLGGVAAAGLTALAIGVSPVYALVIGAACGGMDLLPGFFAGYIVGYMMKYTEKYVPDGIDLIGSIILLAPIARLIATGLTPVVNNTLIKIGDIIQSSTDANPLIMGIVLGGIITVVGTAPLSSMALTALLGLTGAPMAIGAMAAFSSAFMNSALFHRLKLGDRKSTISVGIEPLSQADIVSANPIPIYVTNFFGGAIAGIIIAWSGMINNATGTATPIAGFLVMFGFNSLTKVIIYGVVMAIIGTIAGIVGSIVFKKYPIITKKQMLERDTTT

SEQ ID NO: 418 - protein, 152 aa, Staphylococcus epidermidis
MEIKQIKYFVEVVRQGGMTQASEHLYIAQSTISKAIKNIENEYDITLFDRSQKQIKLTDIGQTFYDNSLEFLALFEKLSLEMNDIVNVQKGHIKIGLSPMMNVQMFTNALNQFHRLYPNVTYEVIEGGGKIVENLTSNDDVDIGITTLPVDL

SEQ ID NO: 419 - protein, 417 aa, Staphylococcus epidermidis
LSESANSFYLHVDDFLIRIVKECLLTHVNSKLMLWRFVMGSFFNRMTRKENPTIYQNKDGHLKRTLRVRDFLALGVGTIVSTSIFTLPGVVAAEHAGPAVALSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSR

SEQ ID NO: 420 - protein, 196 aa, Staphylococcus epidermidis
DPETLFIVMSQILFHPLVGGFLLAAILAAIMSTISSQLLVTSSSLTEDFYKLIRGSDKASSHQKEFVLIGRLSVLLVAIVAITIAWHPNDTILNLVGNAWAGFGAAFSPLVLYSLYWKDLTRAGAISGMVAGAVVVIVWISWIKPLATINAFFGMYEIIPGFIVSVLITYIVSKLTKKPDDYVIENLNKVKHVVKE

SEQ ID NO: 421 - protein, 138 aa, Staphylococcus epidermidis
DQLFKVTESELIEIQDIGDKLAQSVVTYLENSDIRSLIEKLSNKNVNMSYKGIKTTEIEGHPDFSGKTIVLTGKLEQMTRNEASEWLKMQGAKVTNSVTKSTDIVIAGADAGSKLAKAEKYGTEIWTEAAFIEKQNGI

SEQ ID NO: 422 - protein, 402 aa, Staphylococcus epidermidis
MKRTIFLLMSILLLLTACGDGHKQTSSDKEQSEHKDNHNKNQVKQIATDKKVQGDNYRTILPFKESQARGLLQDNMANGYNGEDFESGLLELSKEIFPTNKYLYQDGQYLDKKTINAYLDPKYTKKEIDKMSEKEKKSKNANENLGLNPSHNGETDEEKIAENSPAYLSNILEQDFYGNSDSKGKNIKGMTIGLAMNSVYYYKKEKDGETFSKDLSDKEIEKQGKQMASEMLSRLRENSDLKDIPIHFAIYKQSSQDSITPGEFIVGTTVEEGKTKINSWDNINEKAALIPSSTAADYDETLNNNFKQFNDNLQSYFSNFTQAVGKVKFVNKKAKQLTVDLPIDYYGQAETIGITQYVTEQAEKYFDKLDEYEIRIKDGNTPRALISKTKDDKEPQVHIYHN

SEQ ID NO: 423 - protein, 315 aa, Staphylococcus epidermidis
LDTSKGQSSMEEVLKLKIPASTANLGVGFDSIGMALDKYLHMSIRKIERANWEFLYYSSELEGLPKDENNYIYQTALNVARKYNVTLPSLQIEMRSDIPLARGLGSSASALVGALFIANYFGNIQLSKYELLQLATEIEGHPDNVAPTIYGGLIAGFYNPITKITDVARIEVPHVDIILTIPPYELRTEDSRRVLPDTFSHKGAVQNSAISNTMICALIQHKYKLAGKMMEQDGFHEPYRQHLIPEFNQVRKLSRQHDAYATVISGAGPTILTLCPKEKSGKLVRTLREKINNCASELVTINEIGVKDEVVYLKS

SEQ ID NO: 424 - protein, 276 aa, Staphylococcus epidermidis
LLKGVLYYMTQYKMVVLDMDDTLMNSDNKLSIETKSYLLDIQKRGYYVVLASGRPTEGMLPTARELELNKYNSFIISYNGGKTINMANENVEVDQPVSKEDFDNIVDYCRDKNFLVLTYDNGYIIHDSSHEYMNIESQLTGLPMNRVADLKEYINHSVPKVMGVDYVGHITEARIELDGYFNNDIDVTTSKPFFLEFMAKNVSKGNAIKALCKRLQISLEEVIVFGDSLNDKSMFEVAGYSVAMGNASDELKKIADEVTLDNNSNGIPYALKELLV

The invention claimed is:

1. An isolated antigenic polypeptide, encoded by an isolated an expression vector configured to express a DNA molecule represented by the DNA sequence SEQ ID NO.: 41.

2. The antigenic polypeptide according to claim 1, wherein said polypeptide is represented by the amino acid sequence of SEQ ID NO.:209.

3. The antigenic polypeptide according to claim 1 wherein said polypeptide is from a bacterium selected from the group consisting of *Staphylococcus* sp.;*Enterococcus faecalis; Mycobacterium tuberculosis; Streptococcus* group B,"*Streptococcus pneumoniae; Helicobacter pylon; Neisseria gonorrhea; Streptococcus* group A; *Borrelia burgdorferi; Coccidiodes immitis; Histoplasma sapsulatum; Neisseria meningitides* type B; *Shigella flexneri,*" *Escherichia coli*; and *Haemophilus influenza.*

4. The antigenic polypeptide according to claim 3 wherein the *Staphylococcus* sp is *Staphylococcus aureus* or *Staphylococcus epidermidis.*

* * * * *